US010323236B2

(12) United States Patent
Liu et al.

(10) Patent No.: US 10,323,236 B2
(45) Date of Patent: *Jun. 18, 2019

(54) EVALUATION AND IMPROVEMENT OF NUCLEASE CLEAVAGE SPECIFICITY

(75) Inventors: David R. Liu, Lexington, MA (US); John Paul Guilinger, Ridgway, CO (US); Vikram Pattanayak, Cambridge, MA (US)

(73) Assignee: President and Fellows of Harvard College, Cambridge, MA (US)

(*) Notice: Subject to any disclaimer, the term of this patent is extended or adjusted under 35 U.S.C. 154(b) by 35 days.

This patent is subject to a terminal disclaimer.

(21) Appl. No.: 14/234,031

(22) PCT Filed: Jul. 22, 2012

(86) PCT No.: PCT/US2012/047778
§ 371 (c)(1),
(2), (4) Date: Mar. 24, 2014

(87) PCT Pub. No.: WO2013/066438
PCT Pub. Date: May 10, 2013

(65) Prior Publication Data
US 2014/0234289 A1 Aug. 21, 2014

Related U.S. Application Data

(60) Provisional application No. 61/510,841, filed on Jul. 22, 2011.

(51) Int. Cl.
*C12Q 1/68* (2018.01)
*C12N 9/22* (2006.01)
(Continued)

(52) U.S. Cl.
CPC ............ *C12N 9/22* (2013.01); *C12Q 1/44* (2013.01); *C12Q 1/68* (2013.01); *C12Q 1/6874* (2013.01)

(58) Field of Classification Search
USPC ....... 435/6.1, 6.11, 6.12, 91.1, 91.2; 436/94, 436/501; 536/23.1, 24.3, 24.33, 25.3
See application file for complete search history.

(56) References Cited

U.S. PATENT DOCUMENTS 4,880,635 A  11/1989 Janoff et al.
4,906,477 A  3/1990 Kurono et al.
(Continued)

FOREIGN PATENT DOCUMENTS

AU  2012244264 A1  11/2012
AU  2015252023 A1  11/2015
(Continued)

OTHER PUBLICATIONS

Bitinaite et al., FokI dimerization is required for DNA cleavage. Proc. Natl. Acad. Sci. USA, 95, 10570-10575, 1998.*
(Continued)

*Primary Examiner* — Frank W Lu
(74) *Attorney, Agent, or Firm* — Wolf, Greenfield & Sacks, P.C.

(57) ABSTRACT

Engineered nucleases (e.g., zinc finger nucleases (ZFNs), transcriptional activator-like effector nucleases (TALENs), and others) are promising tools for genome manipulation and determining off-target cleavage sites of these enzymes is of great interest. We developed an in vitro selection method that interrogates $10^{11}$ DNA sequences for their ability to be cleaved by active, dimeric nucleases, e.g., ZFNs and TALENs. The method revealed hundreds of thousands of DNA sequences, some present in the human genome, that can be cleaved in vitro by two ZFNs, CCR5-224 and VF2468, which target the endogenous human CCR5 and VEGF-A genes, respectively. Our findings establish an energy compensation model of ZFN specificity in which excess binding energy contributes to off-target ZFN cleavage and suggest strategies for the improvement of future nuclease design. It
(Continued)

was also observed that TALENs can achieve cleavage specificity similar to or higher than that observed in ZFNs.

17 Claims, 34 Drawing Sheets

Specification includes a Sequence Listing.

(51) Int. Cl.
  *C12Q 1/44* (2006.01)
  *C12Q 1/6874* (2018.01)

(56) References Cited

U.S. PATENT DOCUMENTS

| | | | |
|---|---|---|---|
| 4,911,928 A | 3/1990 | Wallach | |
| 4,917,951 A | 4/1990 | Wallach | |
| 4,920,016 A | 4/1990 | Allen et al. | |
| 4,921,757 A | 5/1990 | Wheatley et al. | |
| 5,139,941 A | 8/1992 | Muzyczka et al. | |
| 5,780,053 A | 7/1998 | Ashley et al. | |
| 5,962,313 A | 10/1999 | Podsakoff et al. | |
| 6,057,153 A | 5/2000 | Shaji et al. | |
| 6,453,242 B1 | 9/2002 | Eisenberg et al. | |
| 6,503,717 B2 | 1/2003 | Case et al. | |
| 6,534,261 B1 | 3/2003 | Cox, III et al. | |
| 6,599,692 B1 | 7/2003 | Case et al. | |
| 6,607,882 B1 | 8/2003 | Cox, III et al. | |
| 6,824,978 B1 | 11/2004 | Cox, III et al. | |
| 6,933,113 B2 | 8/2005 | Case et al. | |
| 6,979,539 B2 | 12/2005 | Cox, III et al. | |
| 7,013,219 B2 | 3/2006 | Case et al. | |
| 7,163,824 B2 | 1/2007 | Cox, III et al. | |
| 7,479,573 B2 | 1/2009 | Chu et al. | |
| 7,794,931 B2 | 9/2010 | Breaker et al. | |
| 7,919,277 B2 | 4/2011 | Russell et al. | |
| 7,993,672 B2 | 8/2011 | Huang et al. | |
| 8,361,725 B2 | 1/2013 | Russell et al. | |
| 8,394,604 B2 | 3/2013 | Liu et al. | |
| 8,546,553 B2 | 10/2013 | Terns et al. | |
| 8,569,256 B2 | 10/2013 | Heyes et al. | |
| 8,680,069 B2 | 3/2014 | de Fougerolles et al. | |
| 8,691,750 B2 | 4/2014 | Constien et al. | |
| 8,697,359 B1 | 4/2014 | Zhang | |
| 8,709,466 B2 | 4/2014 | Coady et al. | |
| 8,728,526 B2 | 5/2014 | Heller | |
| 8,748,667 B2 | 6/2014 | Budzik et al. | |
| 8,758,810 B2 | 6/2014 | Okada et al. | |
| 8,759,103 B2 | 6/2014 | Kim et al. | |
| 8,759,104 B2 | 6/2014 | Unciti-Broceta et al. | |
| 8,771,728 B2 | 7/2014 | Huang et al. | |
| 8,790,664 B2 | 7/2014 | Pitard et al. | |
| 8,795,965 B2 | 8/2014 | Zhang | |
| 8,846,578 B2 | 9/2014 | McCray et al. | |
| 8,993,233 B2 | 3/2015 | Zhang et al. | |
| 8,999,641 B2 | 4/2015 | Zhang et al. | |
| 9,068,179 B1 | 6/2015 | Liu et al. | |
| 9,163,284 B2 | 10/2015 | Liu et al. | |
| 9,228,207 B2 | 1/2016 | Liu et al. | |
| 9,234,213 B2 | 1/2016 | Wu | |
| 9,322,006 B2 | 4/2016 | Liu et al. | |
| 9,322,037 B2 | 4/2016 | Liu et al. | |
| 9,340,799 B2 | 5/2016 | Liu et al. | |
| 9,340,800 B2 | 5/2016 | Liu et al. | |
| 9,359,599 B2 | 6/2016 | Liu et al. | |
| 9,388,430 B2 | 7/2016 | Liu et al. | |
| 9,512,446 B1 | 12/2016 | Joung et al. | |
| 9,526,724 B2 | 12/2016 | Oshlack et al. | |
| 9,737,604 B2 | 8/2017 | Liu et al. | |
| 9,816,093 B1 | 11/2017 | Donohoue et al. | |
| 9,840,699 B2 | 12/2017 | Liu et al. | |
| 9,873,907 B2 | 1/2018 | Zeiner et al. | |
| 9,879,270 B2 | 1/2018 | Hittinger et al. | |
| 9,938,288 B1 | 4/2018 | Kishi et al. | |
| 9,982,279 B1 | 5/2018 | Gill et al. | |
| 9,999,671 B2 | 6/2018 | Liu et al. | |
| 10,077,453 B2 | 9/2018 | Liu et al. | |
| 2004/0003420 A1 | 1/2004 | Kuhn et al. | |
| 2004/0115184 A1 | 6/2004 | Smith et al. | |
| 2005/0222030 A1 | 10/2005 | Allison et al. | |
| 2006/0088864 A1 | 4/2006 | Smolke et al. | |
| 2006/0104984 A1 | 5/2006 | Littlefield et al. | |
| 2006/0246568 A1 | 11/2006 | Honjo et al. | |
| 2007/0264692 A1 | 11/2007 | Liu et al. | |
| 2008/0124725 A1 | 5/2008 | Barrangou et al. | |
| 2008/0182254 A1 | 7/2008 | Hall et al. | |
| 2009/0130718 A1 | 5/2009 | Short | |
| 2009/0234109 A1 | 9/2009 | Han et al. | |
| 2010/0076057 A1 | 3/2010 | Sontheimer et al. | |
| 2010/0093617 A1 | 4/2010 | Barrangou et al. | |
| 2010/0104690 A1 | 4/2010 | Barrangou et al. | |
| 2010/0316643 A1 | 12/2010 | Eckert et al. | |
| 2011/0059160 A1 | 3/2011 | Essner et al. | |
| 2011/0104787 A1 | 5/2011 | Church et al. | |
| 2011/0189776 A1 | 8/2011 | Terns et al. | |
| 2011/0217739 A1 | 9/2011 | Terns et al. | |
| 2012/0129759 A1 | 5/2012 | Liu et al. | |
| 2012/0141523 A1 | 6/2012 | Castado et al. | |
| 2012/0244601 A1 | 9/2012 | Bertozzi et al. | |
| 2012/0270273 A1 | 10/2012 | Zhang et al. | |
| 2013/0117869 A1 | 5/2013 | Duchateau et al. | |
| 2013/0130248 A1 | 5/2013 | Haurwitz et al. | |
| 2013/0158245 A1 | 6/2013 | Russell et al. | |
| 2013/0165389 A1 | 6/2013 | Schellenberger et al. | |
| 2013/0309720 A1 | 11/2013 | Schultz et al. | |
| 2013/0344117 A1 | 12/2013 | Mirosevich et al. | |
| 2014/0004280 A1 | 1/2014 | Loomis | |
| 2014/0005269 A1 | 1/2014 | Ngwuluka et al. | |
| 2014/0017214 A1 | 1/2014 | Cost | |
| 2014/0018404 A1 | 1/2014 | Chen et al. | |
| 2014/0044793 A1 | 2/2014 | Goll et al. | |
| 2014/0068797 A1 | 3/2014 | Doudna et al. | |
| 2014/0127752 A1 | 5/2014 | Zhou et al. | |
| 2014/0141094 A1 | 5/2014 | Smyth et al. | |
| 2014/0141487 A1 | 5/2014 | Feldman et al. | |
| 2014/0186843 A1 | 7/2014 | Zhang et al. | |
| 2014/0186958 A1 | 7/2014 | Zhang et al. | |
| 2014/0273037 A1 | 9/2014 | Wu | |
| 2014/0273226 A1 | 9/2014 | Wu | |
| 2014/0273230 A1 | 9/2014 | Chen et al. | |
| 2014/0295556 A1 | 10/2014 | Joung et al. | |
| 2014/0295557 A1 | 10/2014 | Joung et al. | |
| 2014/0342456 A1 | 11/2014 | Mali et al. | |
| 2014/0342457 A1 | 11/2014 | Mali et al. | |
| 2014/0342458 A1 | 11/2014 | Mali et al. | |
| 2014/0349400 A1 | 11/2014 | Jakimo et al. | |
| 2014/0356867 A1 | 12/2014 | Peter et al. | |
| 2014/0356956 A1 | 12/2014 | Church et al. | |
| 2014/0356958 A1 | 12/2014 | Mali et al. | |
| 2014/0356959 A1 | 12/2014 | Church et al. | |
| 2014/0357523 A1 | 12/2014 | Zeiner et al. | |
| 2014/0377868 A1 | 12/2014 | Joung et al. | |
| 2015/0010526 A1 | 1/2015 | Liu et al. | |
| 2015/0031089 A1 | 1/2015 | Lindstrom | |
| 2015/0031132 A1 | 1/2015 | Church et al. | |
| 2015/0031133 A1 | 1/2015 | Church et al. | |
| 2015/0044191 A1 | 2/2015 | Liu et al. | |
| 2015/0044192 A1 | 2/2015 | Liu et al. | |
| 2015/0044772 A1 | 2/2015 | Zhao | |
| 2015/0050699 A1 | 2/2015 | Siksnys et al. | |
| 2015/0056177 A1 | 2/2015 | Liu et al. | |
| 2015/0056629 A1 | 2/2015 | Guthrie-Honea | |
| 2015/0064138 A1 | 3/2015 | Lu et al. | |
| 2015/0064789 A1 | 3/2015 | Paschon et al. | |
| 2015/0071898 A1 | 3/2015 | Liu et al. | |
| 2015/0071899 A1 | 3/2015 | Liu et al. | |
| 2015/0071900 A1 | 3/2015 | Liu et al. | |
| 2015/0071901 A1 | 3/2015 | Liu et al. | |
| 2015/0071902 A1 | 3/2015 | Liu et al. | |
| 2015/0071903 A1 | 3/2015 | Liu et al. | |
| 2015/0071906 A1 | 3/2015 | Liu et al. | |
| 2015/0079680 A1 | 3/2015 | Bradley et al. | |
| 2015/0079681 A1 | 3/2015 | Zhang | |
| 2015/0098954 A1 | 4/2015 | Hyde et al. | |

(56) References Cited

U.S. PATENT DOCUMENTS

| | | |
|---|---|---|
| 2015/0118216 A1 | 4/2015 | Liu et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens et al. |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0315252 A1 | 11/2015 | Haugwitz et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu et al. |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0272965 A1 | 9/2016 | Zhang et al. |
| 2016/0281072 A1 | 9/2016 | Zhang |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0333389 A1 | 11/2016 | Liu et al. |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0350476 A1 | 12/2016 | Quake et al. |
| 2016/0369262 A1 | 12/2016 | Reik et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0226522 A1 | 8/2017 | Hu et al. |
| 2017/0233703 A1 | 8/2017 | Xie et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0283797 A1 | 10/2017 | Robb et al. |
| 2017/0314016 A1 | 11/2017 | Kim et al. |
| 2017/0362635 A1 | 12/2017 | Chamberlain et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127780 A1 | 5/2018 | Liu et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0236081 A1 | 8/2018 | Liu et al. |
| 2018/0237787 A1 | 8/2018 | Maianti et al. |

FOREIGN PATENT DOCUMENTS

| | | |
|---|---|---|
| AU | 2015101792 | 1/2016 |
| BR | 112015013786 A2 | 7/2017 |
| CA | 2 852 593 A1 | 11/2015 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |

(56) References Cited

FOREIGN PATENT DOCUMENTS

| | | |
|---|---|---|
| CN | 104651401 A | 5/2015 |
| CN | 104673816 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 103981211 A | 7/2016 |
| CN | 104017821 A | 7/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |

(56) References Cited

FOREIGN PATENT DOCUMENTS

| | | |
|---|---|---|
| CN | 106434651 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142282 A | 9/2017 |
| CN | 107177591 A | 9/2017 |
| CN | 107177595 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 | 1/2018 |
| CN | 107586777 | 1/2018 |
| CN | 107586779 | 1/2018 |
| CN | 107604003 | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 | 2/2018 |

(56) References Cited

FOREIGN PATENT DOCUMENTS

| | | |
|---|---|---|
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| EP | 2840140 A1 | 2/2005 |
| EP | 2 604 255 A1 | 6/2013 |
| EP | 2 966 170 A1 | 1/2016 |
| EP | 3 009 511 A2 | 4/2016 |
| EP | 3031921 A1 | 6/2016 |
| EP | 3045537 A1 | 7/2016 |
| EP | 3144390 A1 | 3/2017 |
| EP | 3199632 A1 | 8/2017 |
| EP | 3216867 A1 | 9/2017 |
| EP | 3252160 A1 | 12/2017 |
| GB | 2 528 177 A | 1/2016 |
| GB | 2 531 454 A1 | 4/2016 |
| GB | 2542653 A | 3/2017 |
| JP | 2007-501626 A | 2/2007 |
| JP | 2010-539929 A | 12/2010 |
| JP | 2011-081011 A | 4/2011 |
| JP | 2011-523353 A | 8/2011 |
| JP | 2012-525146 A | 10/2012 |
| KR | 101584933 B1 | 1/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 2018-0022465 A | 3/2018 |
| RU | 2016104674 A | 8/2017 |
| RU | 2634395 C1 | 10/2017 |
| RU | 2652899 C1 | 5/2018 |
| WO | WO 2001/036452 A2 | 5/2001 |
| WO | WO-2001/38547 A2 | 5/2001 |
| WO | WO 2002/059296 A2 | 8/2002 |
| WO | WO 2002/068676 A2 | 9/2002 |
| WO | WO 2002/103028 A2 | 12/2002 |
| WO | WO-2004/007684 A2 | 1/2004 |
| WO | WO-2005/014791 A2 | 2/2005 |
| WO | WO 2006/002547 A1 | 1/2006 |
| WO | WO 2006/042112 A2 | 4/2006 |
| WO | WO 2007/025097 A2 | 3/2007 |
| WO | WO 2007/136815 A2 | 11/2007 |
| WO | WO 2008/108989 A2 | 9/2008 |
| WO | WO 2010/011961 A2 | 1/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/102257 A2 | 9/2010 |
| WO | WO 2010/129019 A2 | 11/2010 |
| WO | WO 2010/144150 A2 | 12/2010 |
| WO | WO-2011/002503 A1 | 1/2011 |
| WO | WO 2011/017293 A2 | 2/2011 |
| WO | WO 2011/053868 A1 | 5/2011 |
| WO | WO 2011/053982 A2 | 5/2011 |
| WO | WO 2011/075627 A1 | 6/2011 |
| WO | WO 2011/091311 A2 | 7/2011 |
| WO | WO 2011/109031 A1 | 9/2011 |
| WO | WO 2011/143124 A2 | 11/2011 |
| WO | WO 2012/054726 A1 | 4/2012 |
| WO | WO 2012/065043 A2 | 5/2012 |
| WO | WO-2012/125445 A2 | 9/2012 |
| WO | WO 2012/138927 A2 | 10/2012 |
| WO | WO 2012/158985 A2 | 11/2012 |
| WO | WO 2012/158986 A2 | 11/2012 |
| WO | WO 2012/164565 A1 | 12/2012 |
| WO | WO 2013/012674 A1 | 1/2013 |
| WO | WO 2013/013105 A2 | 1/2013 |
| WO | WO 2013/047844 A1 | 4/2013 |
| WO | WO 2013/066438 A2 | 5/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142378 A9 | 9/2013 |
| WO | WO 2013/142578 A2 | 9/2013 |
| WO | WO 2013/160230 A1 | 10/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A2 | 11/2013 |
| WO | WO 2013/176915 A1 | 11/2013 |
| WO | WO 2013/176916 A1 | 11/2013 |
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A1 | 12/2013 |
| WO | WO 2013/188638 A2 | 12/2013 |
| WO | WO 2013/192278 A1 | 12/2013 |
| WO | WO 2014/005042 A2 | 1/2014 |
| WO | WO 2014/011237 A1 | 1/2014 |
| WO | WO 2014/011901 A1 | 1/2014 |
| WO | WO 2014/018423 A2 | 1/2014 |
| WO | WO 2014/020608 A1 | 2/2014 |
| WO | WO 2014/022120 A1 | 2/2014 |
| WO | WO 2014/022702 A2 | 2/2014 |
| WO | WO 2014/036219 A1 | 3/2014 |
| WO | WO 2014/039513 A2 | 3/2014 |
| WO | WO 2014/039523 A1 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/059173 A2 | 4/2014 |
| WO | WO 2014/059255 A1 | 4/2014 |

(56) References Cited

FOREIGN PATENT DOCUMENTS

| | | |
|---|---|---|
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO-2014/130706 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A2 | 9/2014 |
| WO | WO 2014/152432 A2 | 9/2014 |
| WO | WO 2014/153118 A1 | 9/2014 |
| WO | WO 2014/153470 A2 | 9/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A2 | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015/017866 A1 | 2/2015 |
| WO | WO 2015/018503 A2 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A2 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042585 A1 | 3/2015 |
| WO | WO 2015/048577 A2 | 4/2015 |
| WO | WO 2015/048690 A2 | 4/2015 |
| WO | WO 2015/048707 A2 | 4/2015 |
| WO | WO 2015/048801 A2 | 4/2015 |
| WO | WO 2015/049897 A1 | 4/2015 |
| WO | WO 2015/051191 A1 | 4/2015 |
| WO | WO 2015/052133 A2 | 4/2015 |
| WO | WO 2015/052231 A2 | 4/2015 |
| WO | WO 2015/052335 A1 | 4/2015 |
| WO | WO 2015/053995 A1 | 4/2015 |
| WO | WO 2015/054253 A1 | 4/2015 |

(56) References Cited

FOREIGN PATENT DOCUMENTS

| | | |
|---|---|---|
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO-2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A2 | 6/2015 |
| WO | WO 2015/086798 A1 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A2 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A1 | 6/2015 |
| WO | WO 2015/095804 A1 | 6/2015 |
| WO | WO 2015/099850 A1 | 7/2015 |
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/131110 A1 | 9/2015 |
| WO | WO 2015/133554 A1 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO-2015/143177 A1 | 9/2015 |
| WO | WO-2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A1 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO-2015/165274 A1 | 11/2015 |
| WO | WO-2015/165275 A1 | 11/2015 |
| WO | WO-2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO-2015/172128 A1 | 11/2015 |
| WO | WO-2015/173436 A1 | 11/2015 |
| WO | WO 2015/175642 A1 | 11/2015 |
| WO | WO 2015/179540 A1 | 11/2015 |
| WO | WO-2015/183025 A1 | 12/2015 |
| WO | WO-2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO-2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/195547 A1 | 12/2015 |
| WO | WO 2015/195621 A1 | 12/2015 |

(56) References Cited

FOREIGN PATENT DOCUMENTS

| | | |
|---|---|---|
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |
| WO | WO 2015/200555 A2 | 12/2015 |
| WO | WO 2015/200805 A2 | 12/2015 |
| WO | WO-2016/001978 A1 | 1/2016 |
| WO | WO 2016/004010 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO-2016/011210 A2 | 1/2016 |
| WO | WO 2016/011428 A1 | 1/2016 |
| WO | WO 2016/012544 A2 | 1/2016 |
| WO | WO-2016/012552 A1 | 1/2016 |
| WO | WO 2016/014409 A1 | 1/2016 |
| WO | WO-2016/014565 A2 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A1 | 2/2016 |
| WO | WO 2016/028887 A1 | 2/2016 |
| WO | WO 2016/033088 A1 | 3/2016 |
| WO | WO-2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO-2016/044182 A1 | 3/2016 |
| WO | WO 2016/044416 A1 | 3/2016 |
| WO | WO-2016/046635 A1 | 3/2016 |
| WO | WO 2016/049024 A2 | 3/2016 |
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO-2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A2 | 4/2016 |
| WO | WO 2016/057951 A2 | 4/2016 |
| WO | WO 2016/057961 A2 | 4/2016 |
| WO | WO 2016/061073 A1 | 4/2016 |
| WO | WO 2016/061374 A1 | 4/2016 |
| WO | WO-2016/061481 A1 | 4/2016 |
| WO | WO 2016/061523 A1 | 4/2016 |
| WO | WO 2016/064894 A2 | 4/2016 |
| WO | WO-2016/069282 A1 | 5/2016 |
| WO | WO-2016/069283 A1 | 5/2016 |
| WO | WO 2016/069591 A2 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A1 | 5/2016 |
| WO | WO 2016/076672 A1 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO-2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094679 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |
| WO | WO 2016/104716 A1 | 6/2016 |
| WO | WO 2016/106236 A1 | 6/2016 |
| WO | WO 2016/106239 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/111546 A2 | 7/2016 |
| WO | WO 2016/112242 A1 | 7/2016 |
| WO | WO 2016/112351 A1 | 7/2016 |
| WO | WO 2016/112963 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO-2016/123578 A1 | 8/2016 |
| WO | WO 2016/123578 A1 | 8/2016 |
| WO | WO 2016/126747 A1 | 8/2016 |
| WO | WO 2016/130600 A2 | 8/2016 |
| WO | WO-2016/130600 A2 | 8/2016 |
| WO | WO 2016/130697 A1 | 8/2016 |
| WO | WO-2016/130697 A1 | 8/2016 |
| WO | WO 2016/131009 A1 | 8/2016 |
| WO | WO 2016/132122 A1 | 8/2016 |
| WO | WO 2016/133165 A1 | 8/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |

(56) References Cited

FOREIGN PATENT DOCUMENTS

| | | |
|---|---|---|
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO-2016/161446 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO-2016/167300 A1 | 10/2016 |
| WO | WO 2016/170484 A1 | 10/2016 |
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO-2016/196361 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A2 | 12/2016 |
| WO | WO 2016/205764 A2 | 12/2016 |
| WO | WO 2017/001572 A1 | 1/2017 |
| WO | WO-2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/010556 A1 | 1/2017 |
| WO | WO 2017/011519 A1 | 1/2017 |
| WO | WO 2017/011721 A1 | 1/2017 |
| WO | WO-2017/011804 A1 | 1/2017 |
| WO | WO 2017/015015 A1 | 1/2017 |
| WO | WO 2017/015101 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO-2017/025323 A1 | 2/2017 |
| WO | WO 2017/027423 A1 | 2/2017 |
| WO | WO-2017/028768 A1 | 2/2017 |
| WO | WO-2017/029664 A1 | 2/2017 |
| WO | WO-2017/031360 A1 | 2/2017 |
| WO | WO-2017/031483 A1 | 2/2017 |
| WO | WO-2017/035416 A2 | 3/2017 |
| WO | WO-2017/040348 A1 | 3/2017 |
| WO | WO-2017/040511 A1 | 3/2017 |
| WO | WO-2017/040709 A1 | 3/2017 |
| WO | WO-2017/040786 A1 | 3/2017 |
| WO | WO-2017/040793 A1 | 3/2017 |
| WO | WO-2017/040813 A2 | 3/2017 |
| WO | WO-2017/043573 A1 | 3/2017 |
| WO | WO-2017/043656 A1 | 3/2017 |
| WO | WO-2017/044419 A1 | 3/2017 |
| WO | WO-2017/044776 A1 | 3/2017 |
| WO | WO-2017/044857 A2 | 3/2017 |
| WO | WO-2017/049129 A2 | 3/2017 |
| WO | WO-2017/050963 A1 | 3/2017 |
| WO | WO-2017/053312 A1 | 3/2017 |
| WO | WO-2017/053431 A2 | 3/2017 |
| WO | WO-2017/053713 A1 | 3/2017 |
| WO | WO-2017/053729 A1 | 3/2017 |
| WO | WO-2017/053753 A1 | 3/2017 |
| WO | WO-2017/053762 A1 | 3/2017 |
| WO | WO-2017/053879 A1 | 3/2017 |
| WO | WO-2017/058658 A2 | 4/2017 |
| WO | WO 2017/059241 A1 | 4/2017 |
| WO | WO-2017/062605 A1 | 4/2017 |
| WO | WO-2017/062723 A1 | 4/2017 |
| WO | WO-2017/062754 A1 | 4/2017 |
| WO | WO-2017/062855 A1 | 4/2017 |

(56) References Cited

FOREIGN PATENT DOCUMENTS

| | | |
|---|---|---|
| WO | WO-2017/062886 A1 | 4/2017 |
| WO | WO-2017/062983 A1 | 4/2017 |
| WO | WO-2017/064439 A1 | 4/2017 |
| WO | WO-2017/064546 A1 | 4/2017 |
| WO | WO-2017/064566 A2 | 4/2017 |
| WO | WO-2017/066175 A1 | 4/2017 |
| WO | WO-2017/066497 A2 | 4/2017 |
| WO | WO-2017/066588 A2 | 4/2017 |
| WO | WO 2017/066707 A1 | 4/2017 |
| WO | WO-2017/068377 A1 | 4/2017 |
| WO | WO-2017/069829 A1 | 4/2017 |
| WO | WO-2017/070029 A1 | 4/2017 |
| WO | WO-2017/070032 A1 | 4/2017 |
| WO | WO-2017/070169 A1 | 4/2017 |
| WO | WO-2017/070284 A1 | 4/2017 |
| WO | WO-2017/070598 A1 | 4/2017 |
| WO | WO-2017/070605 A1 | 4/2017 |
| WO | WO-2017/070632 A2 | 4/2017 |
| WO | WO-2017/070633 A2 | 4/2017 |
| WO | WO-2017/072590 A1 | 5/2017 |
| WO | WO-2017/074526 A1 | 5/2017 |
| WO | WO-2017/074962 A1 | 5/2017 |
| WO | WO-2017/075475 A1 | 5/2017 |
| WO | WO-2017/077135 A1 | 5/2017 |
| WO | WO-2017/077329 A2 | 5/2017 |
| WO | WO-2017/078751 A1 | 5/2017 |
| WO | WO-2017/079400 A1 | 5/2017 |
| WO | WO-2017/079428 A1 | 5/2017 |
| WO | WO-2017/079673 A1 | 5/2017 |
| WO | WO-2017/079724 A1 | 5/2017 |
| WO | WO-2017/081097 A1 | 5/2017 |
| WO | WO-2017/081288 A1 | 5/2017 |
| WO | WO-2017/083368 A1 | 5/2017 |
| WO | WO-2017/083722 A1 | 5/2017 |
| WO | WO-2017/083766 A1 | 5/2017 |
| WO | WO-2017/087395 A1 | 5/2017 |
| WO | WO-2017/090724 A1 | 6/2017 |
| WO | WO-2017/091510 A1 | 6/2017 |
| WO | WO-2017/091630 A1 | 6/2017 |
| WO | WO-2017/092201 A1 | 6/2017 |
| WO | WO-2017/093370 A1 | 6/2017 |
| WO | WO-2017/095111 A1 | 6/2017 |
| WO | WO-2017/096041 A1 | 6/2017 |
| WO | WO-2017/096237 A1 | 6/2017 |
| WO | WO-2017/100158 A1 | 6/2017 |
| WO | WO-2017/100431 A2 | 6/2017 |
| WO | WO-2017/104404 A1 | 6/2017 |
| WO | WO-2017/105251 A1 | 6/2017 |
| WO | WO-2017/105350 A1 | 6/2017 |
| WO | WO-2017/105991 A1 | 6/2017 |
| WO | WO-2017/106414 A1 | 6/2017 |
| WO | WO-2017/106528 A2 | 6/2017 |
| WO | WO-2017/106537 A2 | 6/2017 |
| WO | WO-2017/106569 A1 | 6/2017 |
| WO | WO-2017/106616 A1 | 6/2017 |
| WO | WO-2017/106657 A1 | 6/2017 |
| WO | WO-2017/106767 A1 | 6/2017 |
| WO | WO 2017/109134 A1 | 6/2017 |
| WO | WO 2017/109757 A1 | 6/2017 |
| WO | WO-2017/112620 A1 | 6/2017 |
| WO | WO-2017/115268 A1 | 7/2017 |
| WO | WO-2017/117395 A1 | 7/2017 |
| WO | WO-2017/118720 A1 | 7/2017 |
| WO | WO-2017/123609 A1 | 7/2017 |
| WO | WO-2017/123910 A1 | 7/2017 |
| WO | WO-2017/124086 A1 | 7/2017 |
| WO | WO-2017/124100 A1 | 7/2017 |
| WO | WO-2017/124652 A1 | 7/2017 |
| WO | WO-2017/126987 A1 | 7/2017 |
| WO | WO-2017/127807 A1 | 7/2017 |
| WO | WO-2017/131237 A1 | 8/2017 |
| WO | WO-2017/132112 A1 | 8/2017 |
| WO | WO-2017/136520 A1 | 8/2017 |
| WO | WO-2017/136629 A1 | 8/2017 |
| WO | WO-2017/136794 A1 | 8/2017 |
| WO | WO-2017/139264 A1 | 8/2017 |
| WO | WO-2017/139505 A1 | 8/2017 |
| WO | WO 2017/141173 A2 | 8/2017 |
| WO | WO-2017/142835 A1 | 8/2017 |
| WO | WO-2017/142999 A2 | 8/2017 |
| WO | WO-2017/143042 A2 | 8/2017 |
| WO | WO-2017/147278 A1 | 8/2017 |
| WO | WO-2017/147432 A1 | 8/2017 |
| WO | WO-2017/147446 A1 | 8/2017 |
| WO | WO-2017/147555 A1 | 8/2017 |
| WO | WO-2017/151444 A1 | 9/2017 |
| WO | WO-2017/152015 A1 | 9/2017 |
| WO | WO 2017/155717 A1 | 9/2017 |
| WO | WO-2017/157422 A1 | 9/2017 |
| WO | WO-2017/158153 A1 | 9/2017 |
| WO | WO-2017/160689 A1 | 9/2017 |
| WO | WO-2017/160752 A1 | 9/2017 |
| WO | WO-2017/160890 A1 | 9/2017 |
| WO | WO-2017/161068 A1 | 9/2017 |
| WO | WO-2017/165826 A1 | 9/2017 |
| WO | WO-2017/165862 A1 | 9/2017 |
| WO | WO-2017/172644 A2 | 10/2017 |
| WO | WO-2017/172645 A2 | 10/2017 |
| WO | WO-2017/172860 A1 | 10/2017 |
| WO | WO-2017/173004 A1 | 10/2017 |
| WO | WO 2017/173054 A1 | 10/2017 |
| WO | WO-2017/173092 A1 | 10/2017 |
| WO | WO-2017/174329 A1 | 10/2017 |
| WO | WO-2017/176529 A1 | 10/2017 |
| WO | WO-2017/178590 A1 | 10/2017 |
| WO | WO-2017/180694 A1 | 10/2017 |
| WO | WO-2017/180711 A1 | 10/2017 |
| WO | WO-2017/180915 A2 | 10/2017 |
| WO | WO-2017/180926 A1 | 10/2017 |
| WO | WO-2017/181107 A2 | 10/2017 |
| WO | WO-2017/181735 A2 | 10/2017 |
| WO | WO-2017/182468 A1 | 10/2017 |
| WO | WO-2017/184334 A1 | 10/2017 |
| WO | WO-2017/184768 A1 | 10/2017 |
| WO | WO-2017/184786 A1 | 10/2017 |
| WO | WO-2017/186550 A1 | 11/2017 |
| WO | WO-2017/189308 A1 | 11/2017 |
| WO | WO-2017/189336 A1 | 11/2017 |
| WO | WO-2017/190257 A1 | 11/2017 |
| WO | WO-2017/190664 A1 | 11/2017 |
| WO | WO-2017/191210 A1 | 11/2017 |
| WO | WO-2017/192172 A1 | 11/2017 |
| WO | WO-2017/192512 A2 | 11/2017 |
| WO | WO-2017/192544 A1 | 11/2017 |
| WO | WO-2017/192573 A1 | 11/2017 |
| WO | WO-2017/193029 A2 | 11/2017 |
| WO | WO-2017/193053 A1 | 11/2017 |
| WO | WO-2017/196768 A1 | 11/2017 |
| WO | WO-2017/197038 A1 | 11/2017 |
| WO | WO-2017/197238 A1 | 11/2017 |
| WO | WO-2017/197301 A1 | 11/2017 |
| WO | WO-2017/205290 A1 | 11/2017 |
| WO | WO-2017/205423 A1 | 11/2017 |
| WO | WO-2017/207589 A1 | 12/2017 |
| WO | WO-2017/208247 A1 | 12/2017 |
| WO | WO-2017/209809 A1 | 12/2017 |
| WO | WO 2017/213896 A1 | 12/2017 |
| WO | WO 2017/213898 A2 | 12/2017 |
| WO | WO 2017/214460 A1 | 12/2017 |
| WO | WO 2017/216392 A1 | 12/2017 |
| WO | WO 2017/216771 A2 | 12/2017 |
| WO | WO 2017/219027 A1 | 12/2017 |
| WO | WO 2017/219033 A1 | 12/2017 |
| WO | WO 2017/220751 A1 | 12/2017 |
| WO | WO 2017/222370 A1 | 12/2017 |
| WO | WO 2017/222773 A1 | 12/2017 |
| WO | WO 2017/222834 A1 | 12/2017 |
| WO | WO 2017/223107 A1 | 12/2017 |
| WO | WO 2017/223330 A1 | 12/2017 |
| WO | WO 2018/000657 A1 | 1/2018 |
| WO | WO 2018/002719 A1 | 1/2018 |
| WO | WO 2018/005117 A1 | 1/2018 |
| WO | WO 2018/005289 A2 | 1/2018 |
| WO | WO 2018/005691 A1 | 1/2018 |

(56) References Cited

FOREIGN PATENT DOCUMENTS

| | | |
|---|---|---|
| WO | WO 2018/005782 A1 | 1/2018 |
| WO | WO 2018/005873 A1 | 1/2018 |
| WO | WO 2018/06693 A1 | 1/2018 |
| WO | WO 2018/009520 A1 | 1/2018 |
| WO | WO 2018/009562 A1 | 1/2018 |
| WO | WO 2018/009822 A1 | 1/2018 |
| WO | WO 2018/013821 A1 | 1/2018 |
| WO | WO 2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A2 | 2/2018 |
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |
| WO | WO 2018/069474 A1 | 4/2018 |
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |
| WO | WO 2018/085288 A1 | 5/2018 |
| WO | WO 2018/086623 A1 | 5/2018 |
| WO | WO 2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/130830 A1 | 7/2018 |
| WO | WO 2018/138385 A1 | 8/2018 |

OTHER PUBLICATIONS

Liu et al., Distance determination by GIY-YIG intron endonucleases: discrimination between repression and cleavage functions. Nucleic Acids Research, 34, 1755-1764, 2006.*
Partial Supplementary European Search Report for Application No. EP 12845790.0, dated Mar. 18, 2015.
Supplementary European Search Report for Application No. EP 12845790.0, dated Oct. 12, 2015.
International Search Report and Written Opinion for PCT/US2014/052231, dated Dec. 4, 2014.
International Search Report and Written Opinion for PCT/US2014/052231, dated Jan. 30, 2015 (Corrected Version).
International Search Report and Written Opinion for PCT/US2014/050283, dated Nov. 6, 2014.
International Search Report and Written Opinion for PCT/US2014/054247, dated Mar. 27, 2015.
Invitation to Pay Additional Fees for PCT/US2014/054291, mailed Dec. 18, 2014.
International Search Report and Written Opinion for PCT/US2014/054291, dated Mar. 27, 2015.
International Search Report and Written Opinion for PCT/US2014/054252, dated Mar. 5, 2015.
International Search Report and Written Opinion for PCT/US2014/070038, dated Apr. 14, 2015.
No Author Listed, EMBL Accession No. Q99ZW2. Nov. 2012. 2 pages.
No Author Listed, Invitrogen Lipofectamine™ 2000 product sheets, 2002. 2 pages.
No Author Listed, Invitrogen Lipofectamine™ 2000 product sheets, 2005. 3 pages.
No Author Listed, Invitrogen Lipofectamine™ LTX product sheets, 2011. 4 pages.
No Author Listed, Thermo Fisher Scientific—How Cationic Lipid Mediated Transfection Works, retrieved from the internet Aug. 27, 2015. 2 pages.
Genbank Submission; NIH/NCBI, Accession No. J04623. Kita et al., Apr 26, 1993. 2 pages.
NCBI Reference Sequence: NM_002427.3. Wu et al., May 3, 2014. 5 pages.
UniProt Submission; UniProt, Accession No. P01011. Last modified Sep. 18, 2013, version 2. 15 pages.
UniProt Submission; UniProt, Accession No. P04264. Last modified Jun. 11, 2014, version 6. 15 pages.
UniProt Submission; UniProt, Accession No. P04275. Last modified Jul. 9, 2014, version 107. 29 pages.
Alexandrov et al., Signatures of mutational processes in human cancer. Nature. Aug. 22, 2013;500(7463):415-21. doi: 10.1038/nature12477. Epub Aug. 14, 2013.
Barrangou, RNA-mediated programmable DNA cleavage. Nat Biotechnol. Sep. 2012;30(9):836-8. doi: 10.1038/nbt.2357.
Boeckle et al., Melittin analogs with high lytic activity at endosomal pH enhance transfection with purified targeted Pei polyplexes. J Control Release. May 15, 2006;112(2):240-8. Epub Mar. 20, 2006.
Branden and Tooze, Introduction to Protein Structure. 1999; 2nd edition. Garland Science Publisher: 3-12.
Cameron, Recent advances in transgenic technology. Mol Biotechnol. Jun. 1997;7(3):253-65.
Caron et al., Intracellular delivery of a Tat-eGFP fusion protein into muscle cells. Mol Ther. Mar. 2001;3(3):310-8.
Carroll, A CRISPR approach to gene targeting. Mol Ther. Sep. 2012;20(9):1658-60. doi: 10.1038/mt.2012.171.
Chichili et al., Linkers in the structural biology of protein-protein interactions. Protein Science. 2013;22:153-67.
Chung-Il et al., Artificial control of gene expression in mammalian cells by modulating RNA interference through aptamer-small molecule interaction. RNA. May 2006;12(5):710-6. Epub Apr. 10, 2006.

(56) References Cited

OTHER PUBLICATIONS

Cradick et al., ZFN-site searches genomes for zinc finger nuclease target sites and off-target sites. BMC Bioinformatics. May 13, 2011;12:152. doi: 10.1186/1471-2105-12-152.
Fuchs et al., Polyarginine as a multifunctional fusion tag. Protein Sci. Jun. 2005;14(6):1538-44.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Guo et al., Protein tolerance to random amino acid change. Proc Natl Acad Sci U S A. Jun. 22, 2004;101(25):9205-10. Epub Jun. 14, 2004.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hill et al., Functional analysis of conserved histidines in ADP-glucose pyrophosphorylase from *Escherichia coli*. Biochem Biophys Res Commun. Mar. 17, 1998;244(2):573-7.
Houdebine, The methods to generate transgenic animals and to control transgene expression. J Biotechnol. Sep. 25, 2002;98(2-3):145-60.
Kappel et al., Regulating gene expression in transgenic animals. Curr Opin Biotechnol. Oct. 1992;3(5):548-53.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Lazar et al., Transforming growth factor alpha: mutation of aspartic acid 47 and leucine 48 results in different biological activities. Mol Cell Biol. Mar. 1988;8(3):1247-52.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Li et al., Current approaches for engineering proteins with diverse biological properties. Adv Exp Med Biol. 2007;620:18-33.
Liu et al., Fast Colorimetric Sensing of Adenosine and Cocaine Based on a General Sensor Design Involving Aptamers and Nanoparticles. Angew Chem. 2006;118(1):96-100.
Lundberg et al., Delivery of short interfering RNA using endosomolytic cell-penetrating peptides. FASEB J. Sep. 2007;21(11):2664-71. Epub Apr. 26, 2007.
Mullins et al., Transgenesis in nonmurine species. Hypertension. Oct. 1993;22(4):630-3.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
O'Connell et al., Programmable RNA recognition and cleavage by CRISPR/Cas9. Nature. Dec. 11, 2014;516(7530):263-6. doi: 10.1038/nature13769. Epub Sep. 28, 2014.
Pattanayak et al., Determining the specificities of TALENs, Cas9, and other genome-editing enzymes. Methods Enzymol. 2014;546:47-78. doi: 10.1016/B978-0-12-801185-0.00003-9.
Phillips, The challenge of gene therapy and DNA delivery. J Pharm Pharmacol. Sep. 2001;53(9):1169-74.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Samal et al., Cationic polymers and their therapeutic potential. Chem Soc Rev. Nov. 7, 2012;41(21):7147-94. doi: 10.1039/c2cs35094g. Epub Aug. 10, 2012.
Sang, Prospects for transgenesis in the chick. Mech Dev. Sep. 2004;121(9):1179-86.

Schwarze et al., In vivo protein transduction: delivery of a biologically active protein into the mouse. Science. Sep. 3, 1999;285(5433):1569-72.
Sells et al., Delivery of protein into cells using polycationic liposomes. Biotechniques. Jul. 1995;19(1):72-6, 78.
Thorpe et al., Functional correction of episomal mutations with short DNA fragments and RNA-DNA oligonucleotides. J Gene Med. Mar.-Apr. 2002;4(2):195-204.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Winkler et al., Thiamine derivatives bind messenger RNAs directly to regulate bacterial gene expression. Nature. Oct. 31, 2002;419(6910):952-6. Epub Oct. 16, 2002.
Zelphati et al., Intracellular delivery of proteins with a new lipid-mediated delivery system. J Biol Chem. Sep. 14, 2001;276(37):35103-10. Epub Jul. 10, 2001.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
U.S. Appl. No. 61/716,256, filed Oct. 19, 2012, Jinek et al.
U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/837,481, filed Jun. 20, 2013, Cho et al.
U.S. Appl. No. 14/258,458, filed Apr. 22, 2014, Cong.
International Search Report and Written Opinion for PCT/US2012/047778, dated May 30, 2013.
International Preliminary Report on Patentability for PCT/US2012/047778, dated Feb. 6, 2014.
International Search Report for PCT/US2013/032589, dated Jul. 26, 2013.
Genbank Submission; NIH/NCBI, Accession No. J04623. Kita et al., Aug. 26, 1993. 2 pages.
Genbank Submission; NIH/NCBI, Accession No. NC_002737.1. Ferretti et al., Jun. 27, 2013. 1 page.
Genbank Submission; NIH/NCBI, Accession No. NC_015683.1. Trost et al., Jul. 6, 2013. 1 page.
Genbank Submission; NIH/NCBI, Accession No. NC_016782.1. Trost et al., Jun. 11, 2013. 1 page.
Genbank Submission; NIH/NCBI, Accession No. NC_016786.1. Trost et al., Aug. 28, 2013. 1 page.
Genbank Submission; NIH/NCBI, Accession No. NC_017053.1. Fittipaldi et al., Jul. 6, 2013. 1 page.
Genbank Submission; NIH/NCBI, Accession No. NC_017317.1. Trost et al., Jun. 11, 2013. 1 page.
Genbank Submission; NIH/NCBI, Accession No. NC_017861.1. Heidelberg et al., Jun. 11, 2013. 1 page.
Genbank Submission; NIH/NCBI, Accession No. NC_018010.1. Lucas et al., Jun. 11, 2013. 2 pages.
Genbank Submission; NIH/NCBI, Accession No. NC_018721.1. Feng et al., Jun. 11, 2013. 1 pages.
Genbank Submission; NIH/NCBI, Accession No. NC_021284.1. Ku et al., Jul. 12, 2013. 1 page.
Genbank Submission; NIH/NCBI, Accession No. NC_021314.1. Zhang et al., Jul. 15, 2013. 1 page.
Genbank Submission; NIH/NCBI, Accession No. NC_021846.1. Lo et al., Jul. 22, 2013. 1 page.
Genbank Submission; NIH/NCBI, Accession No. NP_472073.1. Glaser et al., Jun. 27, 2013. 2 pages.
Genbank Submission; NIH/NCBI, Accession No. P42212. Prasher et al., Mar. 19, 2014. 7 pages.
Genbank Submission; NIH/NCBI, Accession No. YP_002342100.1. Bernardini et al., Jun. 10, 2013. 2 pages.

(56) References Cited

OTHER PUBLICATIONS

Genbank Submission; NIH/NCBI, Accession No. YP_002344900.1. Gundogdu et al., Mar. 19, 2014. 2 pages.
Genbank Submission; NIH/NCBI, Accession No. YP_820832.1. Makarova et al., Aug. 27, 2013. 2 pages.
UniProt Submission; UniProt, Accession No. P01011. Last modified Jun. 11, 2014, version 2. 15 pages.
Barrangou et al., CRISPR provides acquired resistance against viruses in prokaryotes. Science. Mar. 23, 2007;315(5819):1709-12.
Bedell et al., In vivo genome editing using a high-efficiency TALEN system. Nature. Nov. 1, 2012;491(7422):114-8. Doi: 10.1038/nature11537. Epub Sep. 23, 2012.
Beumer et al., Efficient gene targeting in *Drosophila* with zinc-finger nucleases. Genetics. Apr. 2006;172(4):2391-403. Epub Feb. 1, 2006.
Bibikova et al., Stimulation of homologous recombination through targeted cleavage by chimeric nucleases. Mol Cell Biol. Jan. 2001;21(1):289-97.
Bibikova et al., Targeted chromosomal cleavage and mutagenesis in *Drosophila* using zinc-finger nucleases. Genetics. Jul. 2002;161(3):1169-75.
Boch et al., Breaking the code of DNA binding specificity of TAL-type III effectors. Science. Dec. 11, 2009;326(5959):1509-12. Doi: 10.1126/science.1178811.
BOCH, TALEs of genome targeting. Nat Biotechnol. Feb. 2011;29(2):135-6. Doi: 10.1038/nbt.1767.
Bulyk et al., Exploring the DNA-binding specificities of zinc fingers with DNA microarrays. Proc Natl Acad Sci U S A. Jun. 19, 2001;98(13):7158-63. Epub Jun. 12, 2001.
Cade et al., Highly efficient generation of heritable zebrafish gene mutations lasing homo- and heterodimeric TALENs. Nucleic Acids Res. Sep. 2012;40(16):8001-10. Doi: 10.1093/nar/gks518. Epub Jun. 7, 2012.
Carroll et al., Gene targeting in *Drosophila* and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Charpentier et al., Biotechnology: Rewriting a genome. Nature. Mar. 7, 2013;495(7439):50-1. doi: 10.1038/495050a.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Cobb et al., Directed evolution: an evolving and enabling synthetic biology tool. Curr Opin Chem Biol. Aug. 2012;16(3-4):285-91. doi:10.1016/j.cbpa.2012.05.186. Epub Jun. 4, 2012. Review.
Cong et al., Comprehensive interrogation of natural TALE DNA-binding modules and transcriptional repressor domains. Nat Commun. Jul. 24, 2012;3:968. doi: 10.1038/ncomms1962.

Cong et al., Multiplex genome engineering using CRISPR/Cas systems. Science. Feb. 15, 2013;339(6121):819-23. doi: 10.1126/science.1231143. Epub Jan. 3, 2013.
Cornu et al., DNA-binding specificity is a major determinant of the activity and toxicity of zinc-finger nucleases. Mol Ther. Feb. 2008;16(2):352-8. Epub Nov. 20, 2007.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
De Souza, Primer: genome editing with engineered nucleases. Nat Methods. Jan. 2012;9(1):27.
Deltcheva et al., CRISPR RNA maturation by trans-encoded small RNA and host factor RNase III. Nature. Mar. 31, 2011;471(7340):602-7. doi: 10.1038/nature09886.
DiCarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.
Doyon et al., Enhancing zinc-finger-nuclease activity with improved obligate heterodimeric architectures. Nat Methods. Jan. 2011;8(1):74-9. Doi: 10.1038/nmeth.1539. Epub Dec. 5, 2010.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Esvelt et al., A system for the continuous directed evolution of biomolecules. Nature. Apr. 28, 2011;472(7344):499-503. doi: 10.1038/nature09929. Epub Apr. 10, 2011.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Gabriel et al., An unbiased genome-wide analysis of zinc-finger nuclease specificity. Nat Biotechnol. Aug. 7, 2011;29(9):816-23. doi: 10.1038/nbt.1948.
Gaj et al., Structure-guided reprogramming of serine recombinase DNA sequence specificity. Proc Natl Acad Sci U S A. Jan. 11, 2011;108(2):498-503. doi: 10.1073/pnas.1014214108. Epub Dec. 27, 2010.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gao et al., Crystal structure of a TALE protein reveals an extended N-terminal DNA binding region. Cell Res. Dec. 2012;22(12):1716-20. doi: 10.1038/cr.2012.156. Epub Nov. 13, 2012.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.

(56) References Cited

OTHER PUBLICATIONS

Gilbert et al., CRISPR-mediated modular RNA-guided regulation of transcription in eukaryotes. Cell. 2013 154(2):442-51.
Gordley et al., Evolution of programmable zinc finger-recombinases with activity in human cells. J Mol Biol. Mar. 30, 2007;367(3):802-13. Epub Jan. 12, 2007.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Guo et al., Directed evolution of an enhanced and highly efficient FokI cleavage domain for zinc finger nucleases. J Mol Biol. Jul. 2, 2010;400(1):96-107. doi: 10.1016/j.jmb.2010.04.060. Epub May 4, 2010.
Gupta et al., Zinc finger protein-dependent and -independent contributions to the in vivo off-target activity of zinc finger nucleases. Nucleic Acids Res. Jan. 2011;39(1):381-92. doi: 10.1093/nar/gkq787. Epub Sep. 14, 2010.
Hale et al., RNA-guided RNA cleavage by a CRISPR RNA-Cas protein complex. Cell. Nov. 25, 2009;139(5):945-56. doi: 10.1016/j.cell.2009.07.040.
Händel et al., Expanding or restricting the target site repertoire of zinc-finger nucleases: the inter-domain linker as a major determinant of target site selectivity. Mol Ther. Jan. 2009;17(1):104-11. doi: 10.1038/mt.2008.233. Epub Nov. 11, 2008.
Hartung et al., Cre mutants with altered DNA binding properties. J Biol Chem. Sep. 4, 1998;273(36):22884-91.
Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Horvath et al., CRISPR/Cas, the immune system of bacteria and archaea. Science. Jan. 8, 2010;327(5962):167-70. doi: 10.1126/science.1179555.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Huang et al., Heritable gene targeting in zebrafish using customized TALENs. Nat Biotechnol. Aug. 5, 2011;29(8):699-700. doi: 10.1038/nbt.1939.
Humbert et al., Targeted gene therapies: tools, applications, optimization. Crit Rev Biochem Mol Biol. May-Jun. 2012;47(3):264-81. doi: 10.3109/10409238.2012.658112.
Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Jamieson et al., Drug discovery with engineered zinc-finger proteins. Nat Rev Drug Discov. May 2003;2(5):361-8.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi:.10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al.,TALENs: a widely applicable technology for targeted genome editing. Nat Rev Mol Cell Biol. Jan. 2013;14(1):49-55. doi: 10.1038/nrm3486. Epub Nov. 21, 2012.
Kaiser et al., Gene therapy. Putting the fingers on gene repair. Science. Dec. 23, 2005;310(5756):1894-6.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Kilbride et al., Determinants of product topology in a hybrid Cre-Tn3 resolvase site-specific recombination system. J Mol Biol. Jan. 13, 2006;355(2):185-95. Epub Nov. 9, 2005.
Kim et al., A library of TAL effector nucleases spanning the human genome. Nat Biotechnol Mar. 2013;31(3):251-8. Doi: 10.1038/nbt.2517. Epub Feb. 17, 2013.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., Hybrid restriction enzymes: zinc finger fusions to Fok I cleavage domain. Proc Natl Acad Sci U S A. Feb. 6, 1996;93(3):1156-60.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Klug et al., Zinc fingers: a novel protein fold for nucleic acid recognition. Cold Spring Harb Symp Quant Biol. 1987;52:473-82.
Krishna et al., Structural classification of zinc fingers: survey and summary. Nucleic Acids Res. Jan. 15, 2003;31(2):532-50.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., Tal nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Design of polydactyl zinc-finger proteins for unique addressing within complex genomes. Proc Natl Acad Sci U S A. May 27, 1997;94(11):5525-30.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Maeder et al., CRISPR RNA-guided activation of endogenous human genes. Nat Methods. Oct. 2013;10(10):977-9. doi: 10.1038/nmeth.2598. Epub Jul. 25, 2013.

(56) References Cited

OTHER PUBLICATIONS

Maeder et al., Rapid "open-source" engineering of customized zinc-finger nucleases for highly efficient gene modification. Mol Cell. Jul. 25, 2008;31(2):294-301. doi:10.1016/j.molce1.2008.06.016.

Maeder et al., Robust, synergistic regulation of human gene expression using TALE activators. Nat Methods. Mar. 2013;10(3):243-5. doi: 10.1038/nmeth.2366. Epub Feb. 10, 2013.

Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.

Mak et al., The crystal structure of TAL effector PthXo1 bound to its DNA target. Science. Feb. 10, 2012;335(6069):716-9. doi: 10.1126/science.1216211. Epub Jan. 5, 2012.

Mali et al., Cas9 as a versatile tool for engineeringbiology. Nat Methods. Oct. 2013;10(10):957-63. doi: 10.1038/nmeth.2649.

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

Mali et al., RNA-guided human genome engineering via Cas9. Science. Feb. 15, 2013;339(6121):823-6. doi: 10.1126/science.1232033. Epub Jan. 3, 2013.

Mani et al., Design, engineering, and characterization of zinc finger nucleases. Biochem Biophys Res Commun. Sep. 23, 2005;335(2):447-57.

Meckler et al., Quantitative analysis of TALE-DNA interactions suggests polarity effects. Nucleic Acids Res. Apr. 2013;41(7):4118-28. doi: 10.1093/nar/gkt085. Epub Feb. 13, 2013.

Meng et al., Profiling the DNA-binding specificities of engineered Cys2His2 zinc finger domains using a rapid cell-based method. Nucleic Acids Res. 2007;35(11):e81. Epub May 30, 2007.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Miller et al., A TALE nuclease architecture for efficient genome editing. Nat Biotechnol. Feb. 2011;29(2):143-8. doi:10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.

Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.

Moscou et al., A simple cipher governs DNA recognition by TAL effectors. Science. Dec. 11, 2009;326(5959):1501. doi: 10.1126/science.1178817.

Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.

Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.

Osborn et al., TALEN-based gene correction for epidermolysis bullosa. Mol Ther. Jun. 2013;21(6):1151-9. doi: 10.1038/mt.2013.56. Epub Apr. 2, 2013.

Pabo et al., Design and selection of novel Cys2His2 zinc finger proteins. Annu Rev Biochem. 2001;70:313-40.

Pan et al., Biological and biomedical applications of engineered nucleases. Mol Biotechnol. Sep. 2013;55(1):54-62. doi: 10.1007/s12033-012-9613-9.

Pattanayak et al., High-throughput profiling of off-target DNA cleavage reveals RNA-programmed Cas9 nuclease specificity. Nat Biotechnol. Sep. 2013;31(9):839-43. doi:.10.1038/nbt.2673. Epub Aug. 11, 2013.

Pattanayak et al., Revealing off-target cleavage specificities of zinc-finger nucleases by in vitro selection. Nat Methods. Aug. 7, 2011;8(9):765-70. doi: 10.1038/nmeth.1670.

Pavletich et al., Zinc finger-Dna recognition: crystal structure of a Zif268-DNA complex at 2.1 A. Science. May 10, 1991;252(5007):809-17.

Pennisi et al., The CRISPR craze. Science. Aug. 23, 2013;341(6148):833-6. doi: 10.1126/science.341.6148.833.

Pennisi et al., The tale of the TALEs. Science. Dec. 14, 2012;338(6113):1408-11. doi: 10.1126/science.338.6113.1408.

Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.

Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.

Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.

Petek et al., Frequent endonuclease cleavage at off-target locations in vivo. Mol Ther. May 2010;18(5):983-6. Doi: 10.1038/mt.2010.35. Epub Mar. 9, 2010.

Porteus, Design and testing of zinc finger nucleases for use in mammalian cells. Methods Mol Biol. 2008;435:47-61. doi: 10.1007/978-1-59745-232-8_4.

Proudfoot et al., Zinc finger recombinases with adaptable DNA sequence specificity. PLoS One. Apr. 29, 2011;6(4):e19537. doi: 10.1371/journal.pone.0019537.

Qi et al., Repurposing CRISPR as an RNA-guided platform for sequence-specific control of gene expression. Cell. Feb. 28, 2013;152(5):1173-83. doi: 10.1016/j.cell.2013.02.022.

Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.

Ramirez et al., Unexpected failure rates for modular assembly of engineered zinc fingers. Nat Methods. May 2008;5(5):374-5. Doi: 10.1038/nmeth0508-374.

Ran et al., Double nicking by RNA-guided CRISPR Cas9 for enhanced genome editing specificity. Cell. Sep. 12, 2013;154(6):1380-9. doi: 10.1016/j.cell.2013.08.021. Epub Aug. 29, 2013.

Reyon et al., FLASH assembly of TALENs for high-throughput genome editing. Nat Biotechnol. May 2012;30(5):460-5. doi: 10.1038/nbt.2170.

Sander et al., CRISPR-Cas systems for editing, regulating and targeting genomes. Nat Biotechnol. Apr. 2014;32(4):347-55. doi: 10.1038/nbt.2842. Epub Mar. 2, 2014.

Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.

Sander et al., Targeted gene disruption in somatic zebrafish cells using engineered TALENs. Nat Biotechnol. Aug. 5, 2011;29(8):697-8. doi: 10.1038/nbt.1934.

Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.

Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.

Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.

(56) References Cited

OTHER PUBLICATIONS

Schriefer et al., Low pressure DNA shearing: a method for random DNA sequence analysis. Nucleic Acids Res. Dec. 25, 1990;18(24):7455-6.

Schwank et al., Functional repair of CITR by CRISPR/Cas9 in intestinal stem cell organoids of cystic fibrosis patients. Cell Stem Cell. Dec. 5, 2013;13(6):653-8. doi:10.1016/j.stem.2013.11.002.

Segal et al., Evaluation of a modular strategy for the construction of novel polydactyl zinc finger DNA-binding proteins. Biochemistry. Feb. 25, 2003;42(7):2137-48.

Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.

Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.

Shalem et al., Genome-scale CRISPR-Cas9 knockout screening in human cells. Science. Jan. 3, 2014;343(6166):84-7. doi: 10.1126/science.1247005. Epub Dec. 12, 2013.

Sheridan, First CRISPR-Cas patent opens race to stake out intellectual property. Nat Biotechnol. 2014;32(7):599-601.

Sheridan, Gene therapy finds its niche. Nat Biotechnol. Feb. 2011;29(2):121-8. doi: 10.1038/nbt.1769.

Shimizu et al., Adding fingers to an engineered zinc finger nuclease can reduce activity. Biochemistry. Jun. 7, 2011;50(22):5033-41. doi: 10.1021/bi200393g. Epub May 11, 2011.

Siebert et al., An improved PCR method for walking in uncloned genomic DNA. Nucleic Acids Res. Mar. 25, 1995;23(6):1087-8.

Sun et al., Optimized Tal effector nucleases (TALENs) for use in treatment of sickle cell disease. Mol Biosyst. Apr. 2012;8(4):1255-63. doi: 10.1039/c2mb05461b. Epub Feb. 3, 2012.

Szczepek et al., Structure-based redesign of the dimerization interface reduces the toxicity of zinc-finger nucleases. Nat Biotechnol. Jul. 2007;25(7):786-93. Epub Jul. 1, 2007.

Tebas et al., Gene editing of CCR5 in autologous CD4 T cells of persons infected with HIV. N Engl J Med. Mar. 6, 2014;370(10):901-10. doi: 10.1056/NEJMoa1300662.

Tesson et al., Knockout rats generated by embryo microinjection of TALENs. Nat Biotechnol. Aug. 5, 2011;29(8):695-6. doi: 10.1038/nbt.1940.

Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.

Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.

Urnov et al., Genome editing with engineered zinc finger nucleases. Nat Rev Genet. Sep. 2010;11(9):636-46. doi: 10.1038/nrg2842.

Urnov et al., Highly efficient endogenous human gene correction using designed zinc-finger nucleases. Nature. Jun. 2, 2005;435(7042):646-51. Epub Apr. 3, 2005.

Van Duyne et al., Teaching Cre to follow directions. Proc Natl Acad Sci U S A. Jan. 6, 2009;106(1):4-5. doi: 10.1073/pnas.0811624106. Epub Dec. 31, 2008.

Vanamee et al., FokI requires two specific DNA sites for cleavage. J Mol Biol. May 25, 2001;309(1):69-78.

Wah et al., Structure of Fold has implications for DNA cleavage. Proc Natl Acad Sci U S A. Sep. 1, 1998;95(18):10564-9.

Wang et al., Genetic screens in human cells using the CRISPR-Cas9 system. Science. Jan. 3, 2014;343(6166):80-4. doi: 10.1126/science.1246981. Epub Dec. 12, 2013.

Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.

Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.

Weber et al., Assembly of designer TAL effectors by Golden Gate cloning. PLoS One. 2011;6(5):e19722. doi:10.1371/journal.pone.0019722. Epub May 19, 2011.

Wiedenheft et al., RNA-guided genetic silencing systems in bacteria and archaea. Nature. Feb. 15, 2012;482(7385):331-8. doi: 10.1038/nature10886. Review.

Wolfe et al., Analysis of zinc fingers optimized via phage display: evaluating the utility of a recognition code. J Mol Biol. Feb. 5, 1999;285(5):1917-34.

Wood et al., Targeted genome editing across species using ZFNs and TALENs. Science. Jul. 15, 2011;333(6040):307. doi: 10.1126/science.1207773. Epub Jun. 23, 2011.

Wu et al., Correction of a genetic disease in mouse via use of CRISPR-Cas9. Cell Stem Cell. Dec. 5, 2013;13(6):659-62. doi: 10.1016/j.stem.2013.10.016.

Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.

Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.

Zhang et al., Conditional gene manipulation: Cre-ating a new biological era. J Zhejiang Univ Sci B. Jul. 2012;13(7):511-24. doi: 10.1631/jzus.B1200042. Review.

Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.

Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.

International Preliminary Report on Patentability for PCT/US2014/052231, dated Mar. 3, 2016.

International Preliminary Report on Patentability for PCT/US2014/054247, dated Mar. 17, 2016.

International Preliminary Report on Patentability for PCT/US2014/054291, dated Mar. 17, 2016.

International Preliminary Report on Patentability or PCT/US2014/054252, dated Mar. 17, 2016.

International Preliminary Report on Patentability for PCT/US2014/070038, dated Jun. 23, 2016.

International Search Report and Written Opinion for PCT/US2015/042770, dated Feb. 23, 2016.

International Search Report and Written Opinion for PCT/US2015/058479, dated Feb. 11, 2016.

Bulow et al., Multienzyme systems obtained by gene fusion. Trends Biotechnol. Jul. 1991;9(7):226-31.

Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.

Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.

Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.

Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.

Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.

Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015.

(56) References Cited

OTHER PUBLICATIONS

Wang et al., Efficient delivery of genome-editing proteins using bioreducible lipid nanoparticles. Proc Natl Acad Sci U S A. Feb. 29, 2016. pii: 201520244. [Epub ahead of print], pp. 2868-2873.
International Preliminary Report on Patentability for PCT/US2015/042770, dated Dec. 19, 2016.
Freshney, Culture of Animal Cells. A Manual of Basic Technique. Alan R. Liss, Inc. New York. 1983;4.
Gardlik et al., Vectors and delivery systems in gene therapy. Med Sci Monit. Apr. 2005;11(4):RA110-21. Epub Mar. 24, 2005.
Kim et al., Transcriptional repression by zinc finger peptides. Exploring the potential for applications in gene therapy. J Biol Chem. Nov. 21, 1997;272(47):29795-800.
Komor et al., Programmable editing of a target base in genomic DNA without double-stranded DNA cleavage. Nature. Apr. 20, 2016;533(7603):420-4. doi: 10.1038/nature17946.
Lee et al., Recognition of liposomes by cells: in vitro binding and endocytosis mediated by specific lipid headgroups and surface charge density. Biochim Biophys Acta. Jan. 31, 1992;1103(2):185-97.
Nishida et al., Targeted nucleotide editing using hybrid prokaryotic and vertebrate adaptive immune systems. Science. Sep. 16, 2016;353(6305). pii: aaf8729. doi: 10.1126/science.aaf8729. Epub Aug. 4, 2016.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Yang et al., Genome editing with targeted deaminases. BioRxiv. Preprint. First poted online Jul. 28, 2016.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Barnes et al., Repair and genetic consequences of endogenous DNA base damage in mammalian cells. Annu Rev Genet. 2004;38:445-76.
Beale et al., Comparison of the differential context-dependence of DNA deamination by APOBEC enzymes: correlation with mutation spectra in vivo. J Mol Biol. Mar. 26, 2004;337(3):585-96.
Begley, Scientists unveil the 'most clever CRISPR gadget' so far. STAT, Apr. 20, 2016. https://www.statnews.com/2016/04/20/clever-crispr-advance-unveiled/.
Birling et al., Site-specific recombinases for manipulation of the mouse genome. Methods Mol Biol. 2009;561:245-63. doi: 10.1007/978-1-60327-019-9_16.
Borman, Improved route to single-base genome editing. Chemical & Engineering News, Apr. 25, 2016;94(17)p5. http://cen.acs.org/articles/94/i17/Improved-route-single-base-genome.html.
Britt et al., Re-engineering plant gene targeting. Trends Plant Sci. Feb. 2003;8(2):90-5.
Brusse et al., Spinocerebellar ataxia associated with a mutation in the fibroblast growth factor 14 gene (SCA27): A new phenotype. Mov Disord. Mar. 2006;21(3):396-401.
Buchholz et al., Alteration of Cre recombinase site specificity by substrate-linked protein evolution. Nat Biotechnol. Nov. 2001;19(11):1047-52.
Caldecott et al., Single-strand break repair and genetic disease. Nat Rev Genet. Aug. 2008;9(8):619-31. doi: 10.1038/nrg2380.
Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.
Chavez et al., Highly efficient Cas9-mediated transcriptional programming. Nat Methods. Apr. 2015;12(4):326-8. doi: 10.1038/nmeth.3312. Epub Mar. 2, 2015.
Chavez et al., Precise Cas9 targeting enables genomic mutation prevention. Jun. 14, 2016. doi:https://doi.org/10.1101/058974. [Preprint].
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chu et al., Increasing the efficiency of homology-directed repair for CRISPR-Cas9-induced precise gene editing in mammalian cells. Nat Biotech. Feb. 13, 2015;33:543-8.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cunningham et al., Ensembl 2015. Nucleic Acids Res. Jan. 2015;43(Database issue):D662-9. doi: 10.1093/nar/gku1010. Epub Oct. 28, 2014.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.
Doudna et al., Genome editing. The new frontier of genome engineering with CRISPR-Cas9. Science. Nov. 28, 2014;346(6213):1258096. doi: 10.1126/science.1258096.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Harris et al., RNA editing enzyme APOBEC1 and some of its homologs can act as DNA mutators. Mol Cell. Nov. 2002;10(5):1247-53.
Hess et al., Directed evolution using dCas9-targeted somatic hypermutation in mammalian cells. Nat Methods. Dec. 2016;13(12):1 036-1042. doi: 10.1038/nmeth.4038. Epub Oct. 31, 2016.

(56) References Cited

OTHER PUBLICATIONS

Hilton et al., Enabling functional genomics with genome engineering. Genome Res. Oct. 2015;25(10):1442-55. doi: 10.1101/gr.190124.115.

Hondares et al., Peroxisome Proliferator-activated Receptor α (PPARα) Induces PPARγ Coactivator 1α (PGC-1α) Gene Expression and Contributes to Thermogenic Activation of Brown Fat. J Biol. Chem Oct. 2011; 286(50):43112-22. doi: 10.1074/jbc.M111.252775.

Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.

Hower et al., Shape-based peak identification for ChIP-Seq. BMC Bioinformatics. Jan. 12, 2011;12:15. doi: 10.1186/1471-2105-12-15.

International Preliminary Report on patentability for PCT/US2014/050283, dated Feb. 18, 2016.

International Preliminary Report on Patentability for PCT/US2015/058479, dated May 11, 2017.

International Search Report and Written Opinion for PCT/US2016/058344, dated Apr. 20, 2017.

International Search Report and Written Opinion for PCT/US2017/045381, dated Oct. 26, 2017.

International Search Report and Written Opinion for PCT/US2017/046144, dated Oct. 10, 2017.

Invitation to Pay Additional Fees for PCT/US2016/058344, mailed Mar. 1, 2017.

Invitation to Pay Additional Fees for PCT/US2017/48390, mailed Nov. 7, 2017.

Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

Kellendonk et al., Regulation of Cre recombinase activity by the synthetic steroid RU 486. Nucleic Acids Res. Apr. 15, 1996;24(8):1404-11.

Kim et al., Genome-wide target specificities of CRISPR RNA-guided programmable deaminases. Nat Biotechnol. May 2017;35(5):475-480. doi: 10.1038/nbt.3852. Epub Apr. 10, 2017.

Kim et al., Highly efficient RNA-guided base editing in mouse embryos. Nat Biotechnol. May 2017;35(5):435-437. doi: 10.1038/nbt.3816. Epub Feb. 27, 2017.

Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.

Kim et al., The role of apolipoprotein E in Alzheimer's disease. Neuron. Aug. 13, 2009;63(3):287-303. doi: 10.1016/j.neuron.2009.06.026.

Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.

Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.

Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.

Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.

Klippel et al., Isolation and characterization of unusual gin mutants. EMBO J. Dec. 1, 1988;7(12):3983-9.

Klippel et al., The DNA invertase Gin of phage Mu: formation of a covalent complex with DNA via a phosphoserine at amino acid position 9. EMBO J. Apr. 1988;7(4):1229-37.

Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.

Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.

Li et al., Highly efficient and precise base editing in discarded human tripronuclear embryos. Protein Cell. Aug. 19, 2017. doi: 10.1007/s13238-017-0458-7. [Epub ahead of print].

Lin et al., Enhanced homology-directed human genome engineering by controlled timing of CRISPR/Cas9 delivery. Elife. Dec. 15, 2014;3:e04766. doi: 10.7554/eLife.04766.

Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.

Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.

Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.

Ma et al., Targeted AID-mediated mutagenesis (TAM) enables efficient genomic diversification in mammalian cells. Nature Methods. Oct. 2016;13:1029-35. doi:10.1038/nmeth.4027.

Marioni et al., DNA methylation age of blood predicts all-cause mortality in later life. Genome Biol. Jan. 30, 2015;16:25. doi: 10.1186/s13059-015-0584-6.

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.

Mol et al., Crystal structure of human uracil-DNA glycosylase in complex with a protein inhibitor: protein mimicry of DNA. Cell. Sep. 8, 1995;82(5):701-8.

Offord, Advances in Genome Editing. The Scientist, Apr. 20, 2016. http://www.the-scientist.com/?articles.view/articleNo/45903/title/Advances-in-Genome-Editing/.

Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.

Petolino et al., Editing Plant Genomes: a new era of crop improvement. Plant Biotechnol J. Feb. 2016;14(2):435-6. doi: 10.1111/pbi.12542.

Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.

Prorocic et al., Zinc-finger recombinase activities in vitro. Nucleic Acids Res. Nov. 2011;39(21):9316-28. doi: 10.1093/nar/gkr652. Epub Aug. 17, 2011.

(56) References Cited

OTHER PUBLICATIONS

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Putnam et al., Protein mimicry of DNA from crystal structures of the uracil-DNA glycosylase inhibitor protein and its complex with Escherichia coli uracil-DNA glycosylase. J Mol Biol. Mar. 26, 1999;287(2):331-46.
Ran et al., Genome engineering using the CRISPR-Cas9 system. Nat Protoc. Nov. 2013;8(11):2281-308. doi: 10.1038/nprot.2013.143. Epub Oct. 24, 2013.
Ran et al., In vivo genome editing using *Staphylococcus aureus* Cas9. Nature. Apr. 9, 2015;520(7546):186-91. doi: 10.1038/nature14299. Epub Apr. 1, 2015.
Rath et al., Fidelity of end joining in mammalian episomes and the impact of Metnase on joint processing. BMC Mol Biol. Mar. 22, 2014;15:6. doi: 10.1186/1471-2199-15-6.
Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).
Rebuzzini et al., New mammalian cellular systems to study mutations introduced at the break site by non-homologous end-joining. DNA Repair (Amst). May 2, 2005;4(5):546-55.
Rees et al., Improving the Dna specificity and applicability of base editing through protein engineering and protein delivery. Nat Commun. Jun. 6, 2017;8:15790. doi: 10.1038/ncomms15790.
Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.
Sadelain et al., Safe harbours for the integration of new DNA in the human genome. Nat Rev Cancer. Dec. 1, 2011;12(1):51-8. doi: 10.1038/nrc3179.
Sanjana et al., A transcription activator-like effector toolbox for genome engineering. Nat Protoc. Jan. 5, 2012;7(1):171-92. doi: 10.1038/nprot.2011.431.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sclimenti et al., Directed evolution of a recombinase for improved genomic integration at a native human sequence. Nucleic Acids Res. Dec. 15, 2001;29(24):5044-51.
Seripa et al., The missing ApoE allele. Ann Hum Genet. Jul. 2007;71(Pt 4):496-500. Epub Jan. 22, 2007.
Shah et al., Inteins: nature's gift to protein chemists. Chem Sci. 2014;5(1):446-461.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Simonelli et al., Base excision repair intermediates are mutagenic in mammalian cells. Nucleic Acids Res. Aug. 2, 2005;33(14):4404-11. Print 2005.
Sjoblom et al., The consensus coding sequences of human breast and colorectal cancers. Science. Oct. 13, 2006;314(5797):268-74. Epub Sep. 7, 2006.
Slaymaker et al., Rationally engineered Cas9 nucleases with improved specificity. Science. Jan. 1, 2016;351(6268):84-8. doi: 10.1126/science.aad5227. Epub Dec. 1, 2015.
Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.
Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Swarts et aL, Argonaute of the archaeon *Pyrococcus furiosus* is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Tagalakis et al., Lack of RNA-DNA oligonucleotide (chimeraplast) mutagenic activity in mouse embryos. Mol Reprod Dev. Jun. 2005;71(2):140-4.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tirumalai et al., Recognition of core-type DNA sites by lambda integrase. J Mol Biol. Jun. 12, 1998;279(3):513-27.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Wang et al., Nucleation, propagation and cleavage of target RNAs in Ago silencing complexes. Nature. Oct. 8, 2009;461(7265):754-61. doi: 10.1038/nature08434.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.

(56) References Cited

OTHER PUBLICATIONS

Wijnker et al., Managing meiotic recombination in plant breeding. Trends Plant Sci. Dec. 2008;13(12):640-6. doi: 10.1016/j.tplants.2008.09.004. Epub Oct. 22, 2008.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Xu et al., Sequence determinants of improved CRISPR sgRNA design. Genome Res. Aug. 2015;25(8):1147-57. doi: 10.1101/gr.191452.115. Epub Jun. 10, 2015.
Yang et al., Engineering and optimising deaminase fusions for genome editing. Nat Commun. Nov. 2, 2016;7:13330. doi: 10.1038/ncomms13330.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zhang et al., Comparison of non-canonical PAMs for CRISPR/Cas9-mediated DNA cleavage in human cells. Sci Rep. Jun. 2014;4:5405.
Zhang et al., Programmable base editing of zebrafish genome using a modified CRISPR-Cas9 system. Nat Commun. Jul. 25, 2017;8(1):118. doi: 10.1038/s41467-017-00175-6.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zuris et al., Cationic lipid-mediated delivery of proteins enables efficient protein-based genome editing in vitro and in vivo. Nat Biotechnol. 2015;33:73-80.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Abudayyeh et al., C2c2 is a single-component programmable RNA-guided RNA-targeting CRISPR effector. Science Aug. 2016;353(6299):aaf5573. DOI: 10.1126/science.aaf5573.
Billon et al., CRISPR-Mediated Base Editing Enables Efficient Disruption of Eukaryotic Genes through Induction of Stop Codons. Mol Cell. Sep. 21, 2017;67(6):1068-1079.e4. doi: 10.1016/j.molcel.2017.08.008. Epub Sep. 7, 2017.
Bolotin et al., Clustered regularly interspaced short palindrome repeats (CRISPRs) have spacers of extrachromosomal origin. Microbiology. Aug. 2005;151(Pt 8):2551-61.
Briner et al., Guide RNA functional modules direct Cas9 activity and orthogonality. Mol Cell. Oct. 23, 2014;56(2):333-339. doi: 10.1016/j.molcel.2014.09.019.
Brouns et al., Small CRISPR RNAs guide antiviral defense in prokaryotes. Science. Aug. 15, 2008;321(5891):960-4. doi: 10.1126/science.1159689.
Buchwald et al., Long-term, continuous intravenous heparin administration by an implantable infusion pump in ambulatory patients with recurrent venous thrombosis. Surgery. Oct. 1980;88(4):507-16.
Burstein et al., New CRISPR-Cas systems from uncultivated microbes. Nature Feb. 2017;542(7640):237-240.
Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.
Chew et al., A multifunctional AAV-CRISPR-Cas9 and its host response. Nat Methods. Oct. 2016;13(10):868-74. doi: 10.1038/nmeth.3993. Epub Sep. 5, 2016.
Covino et al., The CCL2/CCR2 Axis in the Pathogenesis of HIV-1 Infection: A New Cellular Target for Therapy? Current Drug Targets Dec. 2016;17(1):76-110. DOI : 10.2174/1389450117011512171109 17.
Davis et al., DNA double strand break repair via non-homologous end-joining. Transl Cancer Res. Jun. 2013;2(3):130-143.
DiCarlo et al., Genome engineering in *Saccharomyces cerevisiae* using CRISPR-Cas systems. Nucleic Acids Research Apr. 2013;41(7):4336-43.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Doench et al., Optimized sgRNA design to maximize activity and minimize off-target effects of CRISPR-Cas9. Nat Biotechnol. Feb. 2016;34(2):184-191. doi: 10.1038/nbt.3437.
During et al., Controlled release of dopamine from a polymeric brain implant: in vivo characterization. Ann Neurol. Apr. 1989;25(4):351-6.
East-Seletsky et al., Two distinct RNase activities of CRISPR-C2c2 enable guide-RNA processing and RNA detection. Nature Oct. 2016;538(7624):270-3.
Endo et al., Toward establishing an efficient and versatile gene targeting system in higher plants. Biocatalysis and Agricultural Biotechnology 2014;3,(1):2-6.
Extended European Search Report for EP 15830407.1, dated Mar. 2, 2018.
Fang et al., Synthetic Studies Towards Halichondrins: Synthesis of the Left Halves of Norhalichondrins and Homohalichondrins. Tetrahedron Letters 1992;33(12):1557-1560.
Ferretti et al., Complete genome sequence of an M1 strain of *Streptococcus pyogenes*. Proc Natl Acad Sci U S A. Apr. 10, 2001;98(8):4658-63.
Ferry et al., Rational design of inducible CRISPR guide RNAs for de novo assembly of transcriptional programs. Nat Commun. Mar. 3, 2017;8:14633. doi: 10.1038/ncomms14633.
Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Fukui et al., DNA Mismatch Repair in Eukaryotes and Bacteria. J Nucleic Acids. Jul. 27, 2010;2010. pii: 260512. doi: 10.4061/2010/260512.
Garneau et al., The CRISPR/Cas bacterial immune system cleaves bacteriophage and plasmid DNA. Nature. Nov. 4, 2010;468(7320):67-71. doi: 10.1038/nature09523.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Heller et al., Replisome assembly and the direct restart of stalled replication forks. Nat Rev Mol Cell Biol. Dec. 2006;7(12):932-43. Epub Nov. 8, 2006.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Howard et al., Intracerebral drug delivery in rats with lesion-induced memory deficits. J Neurosurg. Jul. 1989;71(1):105-12.
Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.
Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.
International Preliminary Report on Patentability for PCT/US2016/058344, dated May 3, 2018.
International Search Report and Written Opinion for PCT/US2017/056671, dated Feb. 20, 2018.
International Search Report and Written Opinion for PCT/US2017/068105, dated Apr. 4, 2018.

(56) References Cited

OTHER PUBLICATIONS

International Search Report and Written Opinion for PCT/US2017/068114, dated Mar. 20, 2018.
International Search Report and Written Opinion for PCT/US2017/48390, dated Jan. 9, 2018.
International Search Report for PCT/US2018/021664, dated Jun. 21, 2018.
International Search Report for PCT/US2018/021878, dated Aug. 20, 2018.
International Search Report for PCT/US2018/021880, dated Jun. 20, 2018.
International Search Report for PCT/US2018/024208, dated Aug. 23, 2018.
International Search Report for PCT/US2018/025887, dated Jun. 21, 2018.
International Search Report for PCT/US2018/032460, dated Jul. 11, 2018.
Invitation to Pay Additional Fees for PCT/US2017/056671, dated Dec. 21, 2017.
Invitation to Pay Additional Fees for PCT/US2018/021878, dated Jun. 8, 2018.
Ishino et al., Nucleotide sequence of the iap gene, responsible for alkaline phosphatase isozyme conversion in *Escherichia coli*, and identification of the gene product. J Bacteriol. Dec. 1987;169(12):5429-33.
Jansen et al., Identification of genes that are associated with DNA repeats in prokaryotes. Mol Microbiol. Mar. 2002;43(6):1565-75.
Kaya et al., A bacterial Argonaute with noncanonical guide RNA specificity. Proc. Natl. Acad. Sci. USA Apr. 2016;113(15):4057-62.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., New methods of drug delivery. Science. Sep. 28, 1990;249(4976):1527-33.
Lau et al., Molecular basis for discriminating between normal and damaged bases by the human alkyladenine glycosylase, AAG. Proc Natl Acad Sci U S A. Dec. 5, 2000;97(25):13573-8.
Lee et al., Failure to detect DNA-guided genome editing using Natronobacterium gregoryi Argonaute. Nat Biotechnol. Nov. 28, 2016;35(1):17-18. doi: 10.1038/nbt.3753.
Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.
Levy et al., Inhibition of calcification of bioprosthetic heart valves by local controlled-release diphosphonate. Science. Apr. 12, 1985;228(4696):190-2.
Lewis et al., Building the Class 2 CRISPR-Cas Arsenal. Mol Cell 2017;65(3);377-379.
Li et al., Base editing with a Cpf1-cytidine deaminase fusion. Nat Biotechnol. Apr. 2018;36(4):324-327. doi: 10.1038/nbt.4102. Epub Mar. 19, 2018.
Li et al., Multiplex and homologous recombination-mediated genome editing in *Arabidopsis* and *Nicotiana benthamiana* using guide RNA and Cas9. Nat Biotechnol. Aug. 2013;31(8):688-91. doi: 10.1038/nbt.2654.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Lieber et al., Mechanism and regulation of human non-homologous DNA end-joining. Nat Rev Mol Cell Biol. Sep. 2003;4(9):712-20.
Liu et al., C2c1-sgRNA Complex Structure Reveals RNA-Guided DNA Cleavage Mechanism. Molecular Cell Jan. 2017;65(2):310-22.
Liu et al., Balancing AID and DNA repair during somatic hypermutation. Trends Immunol. Apr. 2009;30(4):173-81. doi: 10.1016/j.it.2009.01.007.
Losey et al., Crystal structure of *Staphylococcus sureus* tRNA adenosine deaminase tadA in complex with RNA. Nature Struct. Mol. Biol. Feb. 2006;13(2):153-9.
Lyons et al., Efficient Recognition of an Unpaired Lesion by a DNA Repair Glycosylase. J. Am. Chem. Soc., 2009;131(49):17742-3. DOI: 10.1021/ja908378y.
Makarova et al., Prokaryotic homologs of Argonaute proteins are predicted to function as key components of a novel system of defense against mobile genetic elements. Biology Direct 2009;4:29.
Makarova et al., An updated evolutionary classification of CRISPR-Cas systems. Nat Rev Microbiol. Nov. 2015;13(11):722-36. doi: 10.1038/nrmicro3569. Epub Sep. 28, 2015.
Makarova et al., Evolution and classification of the CRISPR-Cas systems. Nat Rev Microbiol. Jun. 2011;9(6):467-77. doi: 10.1038/nrmicro2577. Epub May 9, 2011.
Marraffini et al., CRISPR interference limits horizontal gene transfer in staphylococci by targeting DNA. Science. Dec. 19, 2008;322(5909):1843-5. doi: 10.1126/science.1165771.
Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.
Mojica et al., Intervening sequences of regularly spaced prokaryotic repeats derive from foreign genetic elements. J Mol Evol. Feb. 2005;60(2):174-82.
Pearl, Structure and function in the uracil-DNA glycosylase superfamily. Mutat Res. Aug. 30, 2000;460(3-4):165-81.
Plosky et al., CRISPR-Mediated Base Editing without DNA Double-Strand Breaks. Mol Cell. May 19, 2016;62(4):477-8. doi: 10.1016/j.molcel.2016.05.006.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.
Prashant et al., CAS9 transcriptional activators for target specificity screening and paired nickases for cooperative genome engineering. Nature Biotechnology 2013;31(9):833-8.
Ray et al., Homologous recombination: ends as the means. Trends Plant Sci. Oct. 2002;7(10):435-40.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.
Saudek et al., A preliminary trial of the programmable implantable medication system for insulin delivery. N Engl J Med. Aug. 31, 1989;321(9):574-9.
Sefton et al., Implantable pumps. Crit Rev Biomed Eng. 1987;14(3):201-40.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.

(56) References Cited

OTHER PUBLICATIONS

Shee et al., Engineered proteins detect spontaneous DNA breakage in human and bacterial cells. Elife. Oct. 29, 2013;2:e01222. doi: 10.7554/eLife.01222.

Shmakov et al., Discovery and Functional Characterization of Diverse Class 2 CRISPR Cas Systems. Molecular Cell Nov. 2015;60(3):385-97.

Stephens et al., The landscape of cancer genes and mutational processes in breast cancer. Nature Jun. 2012;486:400-404. doi:10.1038/nature11017.

Tang et al., Aptazyme-embedded guide RNAs enable ligand-responsive genome editing and transcriptional activation. Nat Commun. Jun. 28, 2017;8:15939. doi: 10.1038/ncomms15939.

Tourdot et al., A general strategy to enhance immunogenicity of low-affinity HLA-A2.1-associated peptides: implication in the identification of cryptic tumor epitopes. Eur J Immunol. Dec. 2000;30(12):3411-21.

Vagner et al., Efficiency of homologous DNA recombination varies along the Bacillus subtilis chromosome. J Bacteriol. Sep. 1988;170(9):3978-82.

Wang et al., CRISPR-Cas9 Targeting of PCSK9 in Human Hepatocytes In Vivo—Brief Report. Arterioscler Thromb Vasc Biol. May 2016;36(5):783-6. doi: 10.1161/ATVBAHA.116.307227. Epub Mar. 3, 2016.

Wolf et al., tadA, an essential tRNA-specific adenosine deaminase from *Escherichia coli*. EMBO J. Jul. 15, 2002;21(14):3841-51.

Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.

Yamamoto et al., Virological and immunological bases for HIV-1 vaccine design. Uirusu 2007;57(2):133-139. https://doi.org/10.2222/jsv.57.133.

Yamano et al., Crystal Structure of Cpf1 in Complex with Guide RNA and Target DNA. Cell May 2016;165(4)949-62.

Yang et al., New CRISPR-Cas systems discovered. Cell Res. Mar. 2017;27(3):313-314. doi: 10.1038/cr.2017.21. Epub Feb. 21, 2017.

Yang et al., PAM-dependent Target DNA Recognition and Cleavage by C2C1 CRISPR-Cas endonuclease. Cell Dec. 2016;167(7):1814-28.

Zhang et al., Stabilized plasmid-lipid particles for regional gene therapy: formulation and transfection properties. Gene Ther. Aug. 1999;6(8):1438-47.

* cited by examiner a
CCR5-224 wt    5-4    5-3    5-2    5-1

| | (+) site (5'→3') | (-) site (5'→3') | 4 nM | 2 nM | 1 nM | 0.5 nM |
|---|---|---|---|---|---|---|
| wt | GAT GAG GAT GAC | AAA CTG CAA AAG | X | X | X | X |
| 5-4 | GAT GAG Ggg cga | AAA CTG CAA AAG | X | X | X | X |
| 5-3 | GAT GAG Gca cga | AAA CTG CAA AAG | X | X | X | |
| 5-2 | GcT GAG GAT aAC | AAA aTG gAA cAG | X | X | | |
| 5-1 | GAT aca GAT GAC | AAA CTG gAA AAa | X | | | | b
VF2468 wt    4-4    4-3    4-2    4-1

| | (+) site (5'→3') | (-) site (5'→3') | 4 nM | 2 nM | 1 nM | 0.5 nM |
|---|---|---|---|---|---|---|
| wt | GAG TGA GGA | GAC GCT GCT | X | X | X | X |
| 4-4 | GAG TGA aac | GAC GtT GCT | X | X | X | X |
| 4-3 | GAG TGA Gtc | GAC GtT aCT | X | X | X | |
| 4-2 | GtG TGA aaA | GAC GtT GCT | X | X | | |
| 4-1 | GAG TGA GGA | GAC Gaa aCc | X | | | |

TALNS
L18 5'-TTCATTACACCTGCAGCT

TTCATTACACCTGCAGCTCTCATTTTCCATACAGTCAGTATCA
AAGTAATGTGGACGTCGAGAGTAAAAGGTATGTCAGTCATAGT

R18                              AGTATCAATTCTGGAAGA-5'

Target Site

| TALNS | |
|---|---|
| L16 | 5'-TCTTCATTACACCTGC |
| L13 | 5'-TCATTACACCTGC |
| L10 | 5'-TTACACCTGC |
| | TCTTCATTACACCTGCAGCTCTCATTTTCCATACAGTCAGTATCA |
| | AGAAGTAATGTGGACGTCGAGAGTAAAAGGTATGTCAGTCATAGT |
| R16 | GTATGTCAGTCATAGT-5' |
| R13 | GTATGTCAGTCAT-5' |
| R10 | GTATGTCAGT-5' |

Hypothesis: There are two distinct off-target populations
— sites similar to the on-target sequence with exponential enrichment vs. mutations
— sites highly mutant to the on-target sequence

EVALUATION AND IMPROVEMENT OF NUCLEASE CLEAVAGE SPECIFICITY

RELATED APPLICATION

This application is a national stage filing under 35 U.S.C. § 371 of international PCT application, PCT/US2012/047778, filed Jul. 22, 2012, which claims priority under 35 U.S.C. § 119(e) to U.S. provisional patent application, U.S. Ser. No. 61/510,841, filed Jul. 22, 2011, the entire contents of each of which are incorporated herein by reference.

GOVERNMENT SUPPORT

This invention was made with government support under OD006862, GM065400 and BM088040 awarded by National Institutes of Health and HR0011-11-2-0003 awarded by Department of Defense. The government has certain rights in the invention.

BACKGROUND OF THE INVENTION

Site-specific endonucleases theoretically allow for the targeted manipulation of a single site within a genome, and are useful in the context of gene targeting as well as for therapeutic applications. In a variety of organisms, including mammals, site-specific endonucleases, for example, zinc-finger nucleases (ZFNs), have been used for genome engineering by stimulating either non-homologous end joining or homologous recombination. In addition to providing powerful research tools, ZFNs also have potential as gene therapy agents, and two ZFNs have recently entered clinical trials: one, CCR5-2246, targeting a human CCR-5 allele as part of an anti-HIV therapeutic approach (NCT00842634, NCT01044654, NCT01252641), and the other one, VF24684, targeting the human VEGF-A promoter as part of an anti-cancer therapeutic approach (NCT01082926).

Precise targeting of the intended target site is crucial for minimizing undesired off-target effects of site-specific nucleases, particularly in therapeutic applications, as imperfect specificity of some engineered site-specific binding domains has been linked to cellular toxicity. However, the site preferences for engineered site-specific nucleases, including current ZFNs, which cleave their target site after dimerization, has previously only been evaluated in vitro or in silico using methods that are limited to calculating binding and cleavage specificity for monomeric proteins.

Therefore, improved systems for evaluating the off-target sites of nucleases and other nucleic acid cleaving agents are needed and would be useful in the design of nucleases with better specificity, especially for therapeutic applications.

SUMMARY OF THE INVENTION

This invention is at least partly based on the recognition that the reported toxicity of some engineered site-specific endonucleases is based on off-target DNA cleavage, rather than on off-target binding alone. Information about the specificity of site-specific nucleases to date has been based on the assumptions that (i) dimeric nucleases cleave DNA with the same sequence specificity with which isolated monomeric domains bind DNA; and that (ii) the binding of one domain does not influence the binding of the other domain in a given dimeric nuclease. No study to date has reported a method for determining the broad DNA cleavage specificity of active, dimeric site-specific nucleases. Such a method would not only be useful in determining the DNA cleavage specificity of nucleases but would also find use in evaluating the cleavage specificity of other DNA cleaving agents, such as small molecules that cleave DNA.

This invention addresses the shortcomings of previous attempts to evaluate and characterize the sequence specificity of site-specific nucleases, and in particular of nucleases that dimerize or multimerize in order to cleave their target sequence. Some aspects of this invention provide an in vitro selection method to broadly examine the cleavage specificity of active nucleases. In some aspects, the invention provide methods of identifying suitable nuclease target sites that are sufficiently different from any other site within a genome to achieve specific cleavage by a given nuclease without any or at least minimal off-target cleavage. The invention provide methods of evaluating, selecting, and/or designing site specific nucleases with enhanced specificity as compared to current nucleases. Methods for minimizing off-target cleavage by a given nuclease, for example, by enhancing nuclease specificity by designing variant nucleases with binding domains having decreased binding affinity, by lowering the final concentration of the nuclease, and by choosing target sites that differ by at least three base pairs from their closest sequence relatives in the genome are provided. Compositions and kits useful in the practice of the inventive methods are also provided. The provided methods, compositions and kits are also useful in the evaluation, design, and selection of other nucleic acid (e.g., DNA) cleaving agents as would be appreciated by one of skill in the art.

In another aspect, the invention provides nucleases and other nucleic acid cleaving agents designed or selected using the provided system. Isolated ZFNs and TALENs designed, evaluated, or selected according to methods provided herein and pharmaceutical compositions comprising such nucleases are also provided.

Some aspects of this invention provide a method for identifying a target site of a nuclease. In some embodiments, the method comprises (a) providing a nuclease that cuts a double-stranded nucleic acid target site and creates a 5' overhang, wherein the target site comprises a [left-half site]-[spacer sequence]-[right-half site] (LSR) structure, and the nuclease cuts the target site within the spacer sequence. In some embodiments, the method comprises (b) contacting the nuclease with a library of candidate nucleic acid molecules, wherein each nucleic acid molecule comprises a concatemer of a sequence comprising a candidate nuclease target site and a constant insert sequence, under conditions suitable for the nuclease to cut a candidate nucleic acid molecule comprising a target site of the nuclease. In some embodiments, the method comprises (c) filling in the 5' overhangs of a nucleic acid molecule that has been cut twice by the nuclease and comprises a constant insert sequence flanked by a left half-site and cut spacer sequence on one side, and a right half-site and cut spacer sequence on the other side, thereby creating blunt ends. In some embodiments, the method comprises (d) identifying the nuclease target site cut by the nuclease by determining the sequence of the left-half site, the right-half-site, and/or the spacer sequence of the nucleic acid molecule of step (c). In some embodiments, determining the sequence of step (d) comprises ligating sequencing adapters to the blunt ends of the nucleic acid molecule of step (c) and amplifying and/or sequencing the nucleic acid molecule. In some embodiments, the method comprises amplifying the nucleic acid molecule after ligation of the sequencing adapters via PCR. In some embodiments, the method further comprises a step of enriching the nucleic acid molecules of step (c) or step (d) for molecules comprising a single constant insert sequence.

In some embodiments, the step of enriching comprises a size fractionation. In some embodiments, the size fractionation is done by gel purification. In some embodiments, the method further comprises discarding any sequences determined in step (d) if the nucleic acid molecule did not comprise a complementary pair of filled-in 5' overhangs. In some embodiments, the method further comprises compiling a plurality of nuclease target sites identified in step (d), thereby generating a nuclease target site profile. In some embodiments, the nuclease is a therapeutic nuclease which cuts a specific nuclease target site in a gene associated with a disease. In some embodiments, the method further comprises determining a maximum concentration of the therapeutic nuclease at which the therapeutic nuclease cuts the specific nuclease target site, and does not cut more than 10, more than 5, more than 4, more than 3, more than 2, more than 1, or no additional nuclease target sites. In some embodiments, the method further comprises administering the therapeutic nuclease to a subject in an amount effective to generate a final concentration equal or lower than the maximum concentration. In some embodiments, the nuclease comprises an unspecific nucleic acid cleavage domain. In some embodiments, the nuclease comprises a FokI cleavage domain. In some embodiments, the nuclease comprises a nucleic acid cleavage domain that cleaves a target sequence upon cleavage domain dimerization. In some embodiments, the nuclease comprises a binding domain that specifically binds a nucleic acid sequence. In some embodiments, the binding domain comprises a zinc finger. In some embodiments, the binding domain comprises at least 2, at least 3, at least 4, or at least 5 zinc fingers. In some embodiments, the nuclease is a Zinc Finger Nuclease. In some embodiments, the binding domain comprises a Transcriptional Activator-Like Element. In some embodiments, the nuclease is a Transcriptional Activator-Like Element Nuclease (TALEN). In some embodiments, the nuclease comprises an organic compound. In some embodiments, the nuclease comprises an enediyne. In some embodiments, the nuclease is an antibiotic. In some embodiments, the compound is dynemicin, neocarzinostatin, calicheamicin, esperamicin, bleomycin, or a derivative thereof. In some embodiments, the nuclease is a homing endonuclease.

Some aspects of this invention provide libraries of nucleic acid molecule. In some embodiments, a library of nucleic acid molecules is provided that comprises a plurality of nucleic acid molecules, wherein each nucleic acid molecule comprises a concatemer of a candidate nuclease target site and a constant insert sequence spacer sequence. In some embodiments, the candidate nuclease target site comprises a [left-half site]-[spacer sequence]-[right-half site] (LSR) structure. In some embodiments, the left-half site and/or the right-half site is between 10-18 nucleotides long. In some embodiments, the library comprises candidate nuclease target sites that can be cleaved by a nuclease comprising a FokI cleavage domain. In some embodiments, the library comprises candidate nuclease target sites that can be cleaved by a Zinc Finger Nuclease (ZFN), a Transcription Activator-Like Effector Nuclease (TALEN), a homing endonuclease, an organic compound nuclease, an enediyne, an antibiotic nuclease, dynemicin, neocarzinostatin, calicheamicin, esperamicin, and/or bleomycin. In some embodiments, the library comprises at least $10^5$, at least $10^6$, at least $10^7$, at least $10^8$, at least $10^9$, at least $10^{10}$, at least $10^{11}$, or at least $10^{12}$ different candidate nuclease target sites. In some embodiments, the library comprises nucleic acid molecules of a molecular weight of at least 5 kDa, at least 6 kDa, at least 7 kDa, at least 8 kDa, at least 9 kDa, at least 10 kDa, at least 12 kDa, or at least 15 kDa. In some embodiments, the candidate nuclease target sites comprise a partially randomized left-half site, a partially randomized right-half site, and/or a partially randomized spacer sequence. In some embodiments, the library is templated on a known target site of a nuclease of interest. In some embodiments, the nuclease of interest is a ZFN, a TALEN, a homing endonuclease, an organic compound nuclease, an enediyne, an antibiotic nuclease, dynemicin, neocarzinostatin, calicheamicin, esperamicin, bleomycin, or a derivative thereof. In some embodiments, partial randomized sites differ from the consensus site by more than 5%, more than 10%, more than 15%, more than 20%, more than 25%, or more than 30% on average, distributed binomially. In some embodiments, partial randomized sites differ from the consensus site by no more than 10%, no more than 15%, no more than 20%, no more than 25%, nor more than 30%, no more than 40%, or no more than 50% on average, distributed binomially. In some embodiments, the candidate nuclease target sites comprise a randomized spacer sequence.

Some aspects of this invention provide methods of selecting a nuclease based on an evaluation of cleavage specificity. In some embodiments, a method of selecting a nuclease that specifically cuts a consensus target site from a plurality of nucleases is provided. In some embodiments, the method comprises (a) providing a plurality of candidate nucleases that cut the same consensus sequence; (b) for each of the candidate nucleases of step (a), identifying a nuclease target site cleaved by the candidate nuclease that differ from the consensus target site; and (c) selecting a nuclease based on the nuclease target site(s) identified in step (b). In some embodiments, the nuclease selected in step (c) is the nuclease that cleaves the consensus target site with the highest specificity. In some embodiments, the nuclease that cleaves the consensus target site with the highest specificity is the candidate nuclease that cleaves the lowest number of target sites that differ from the consensus site. In some embodiments, the candidate nuclease that cleaves the consensus target site with the highest specificity is the candidate nuclease that cleaves the lowest number of target sites that are different from the consensus site in the context of a target genome. In some embodiments, the candidate nuclease selected in step (c) is a nuclease that does not cleave any target site other than the consensus target site. In some embodiments, the candidate nuclease selected in step (c) is a nuclease that does not cleave any target site other than the consensus target site within the genome of a subject at a therapeutically effective concentration of the nuclease. In some embodiments, the method further comprises contacting a genome with the nuclease selected in step (c). In some embodiments, the genome is a vertebrate, mammalian, human, non-human primate, rodent, mouse rat, hamster, goat, sheep, cattle, dog, cat, reptile, amphibian, fish, nematode, insect, or fly genome. In some embodiments, the genome is within a living cell. In some embodiments, the genome is within a subject. In some embodiments, the consensus target site is within an allele that is associated with a disease or disorder. In some embodiments, cleavage of the consensus target site results in treatment or prevention of the disease or disorder. In some embodiments, cleavage of the consensus target site results in the alleviation of a symptom of the disease or disorder. In some embodiments, the disease is HIV/AIDS, or a proliferative disease. In some embodiments, the allele is a CCR5 or VEGFA allele.

Some aspects of this invention provide a method for selecting a nuclease target site within a genome. In some embodiments, the method comprises (a) identifying a candidate nuclease target site; and (b) using a general purpose computer, comparing the candidate nuclease target site to other sequences within the genome, wherein if the candidate nuclease target site differs from any other sequence within the genome by at least 3, at least 4, at least 5, at least 6, at least 7, at least 8, at least 9, or at least 10 nucleotides, selecting the candidate nuclease site. In some embodiments, the candidate nuclease target site comprises a [left-half site]-[spacer sequence]-[right-half site] (LSR) structure. In some embodiments, the left-half site and/or the right-half site is 10-18 nucleotides long. In some embodiments, the spacer is 10-24 nucleotides long. In some embodiments, the method further comprises designing and/or generating a nuclease targeting the candidate nuclease site selected in step (b). In some embodiments, designing and/or generating is done by recombinant technology. In some embodiments, designing and/or generating comprises designing a binding domain that specifically binds the selected candidate target site, or a half-site thereof. In some embodiments, designing and/or generating comprises conjugating the binding domain with a nucleic acid cleavage domain. In some embodiments, the nucleic acid cleavage domain is a non-specific cleavage domain and/or wherein the nucleic acid cleavage domain must dimerize or multimerize in order to cut a nucleic acid. In some embodiments, the nucleic acid cleavage domain comprises a FokI cleavage domain. In some embodiments, the method further comprises isolating the nuclease. In some embodiments, the nuclease is a Zinc Finger Nuclease (ZFN) or a Transcription Activator-Like Effector Nuclease (TALEN), a homing endonuclease, or is or comprises an organic compound nuclease, an enediyne, an antibiotic nuclease, dynemicin, neocarzinostatin, calicheamicin, esperamicin, bleomycin, or a derivative thereof. In some embodiments, the candidate target site is within a genomic sequence the cleavage of which is known to be associated with an alleviation of a symptom of a disease or disorder. In some embodiments, the disease is HIV/AIDS, or a proliferative disease. In some embodiments, the genomic sequence is a CCR5 or VEGFA sequence.

Some aspects of this invention provide isolated nucleases with enhanced specificity and nucleic acids encoding such nucleases. In some embodiments, an isolated nuclease is provided that has been engineered to cleave a target site within a genome, wherein the nuclease has been selected according to any of the selection methods described herein. In some embodiments, an isolated nuclease is provided that cuts a target site selected according to any of the methods described herein. In some embodiments, an isolated nuclease is provided that is designed or engineered according to any of the concepts or parameters described herein. In some embodiments, the nuclease is a Zinc Finger Nuclease (ZFN) or a Transcription Activator-Like Effector Nuclease (TALEN), a homing endonuclease, or is or comprises an organic compound nuclease, an enediyne, an antibiotic nuclease, dynemicin, neocarzinostatin, calicheamicin, esperamicin, bleomycin, or a derivative thereof.

Some aspects of this invention provide kits comprising nucleases and nuclease compositions. In some embodiments, a kit is provided that comprises an isolated nuclease described herein. In some embodiments, the kit further comprises a nucleic acid comprising a target site of the isolated nuclease. In some embodiments, the kit comprises an excipient and instructions for contacting the nuclease with the excipient to generate a composition suitable for contacting a nucleic acid with the nuclease. In some embodiments, the nucleic acid is a genome or part of a genome. In some embodiments, the genome is within a cell. In some embodiments, the genome is within a subject and the excipient is a pharmaceutically acceptable excipient.

Some aspects of this invention provide pharmaceutical compositions comprising a nuclease or a nucleic acid encoding a nuclease as described herein. In some embodiments, pharmaceutical composition for administration to a subject is provided. In some embodiments, the composition comprises an isolated nuclease described herein or a nucleic acid encoding such a nuclease and a pharmaceutically acceptable excipient.

Other advantages, features, and uses of the invention will be apparent from the detailed description of certain non-limiting embodiments; the drawings, which are schematic and not intended to be drawn to scale; and the claims.

Figure 2:
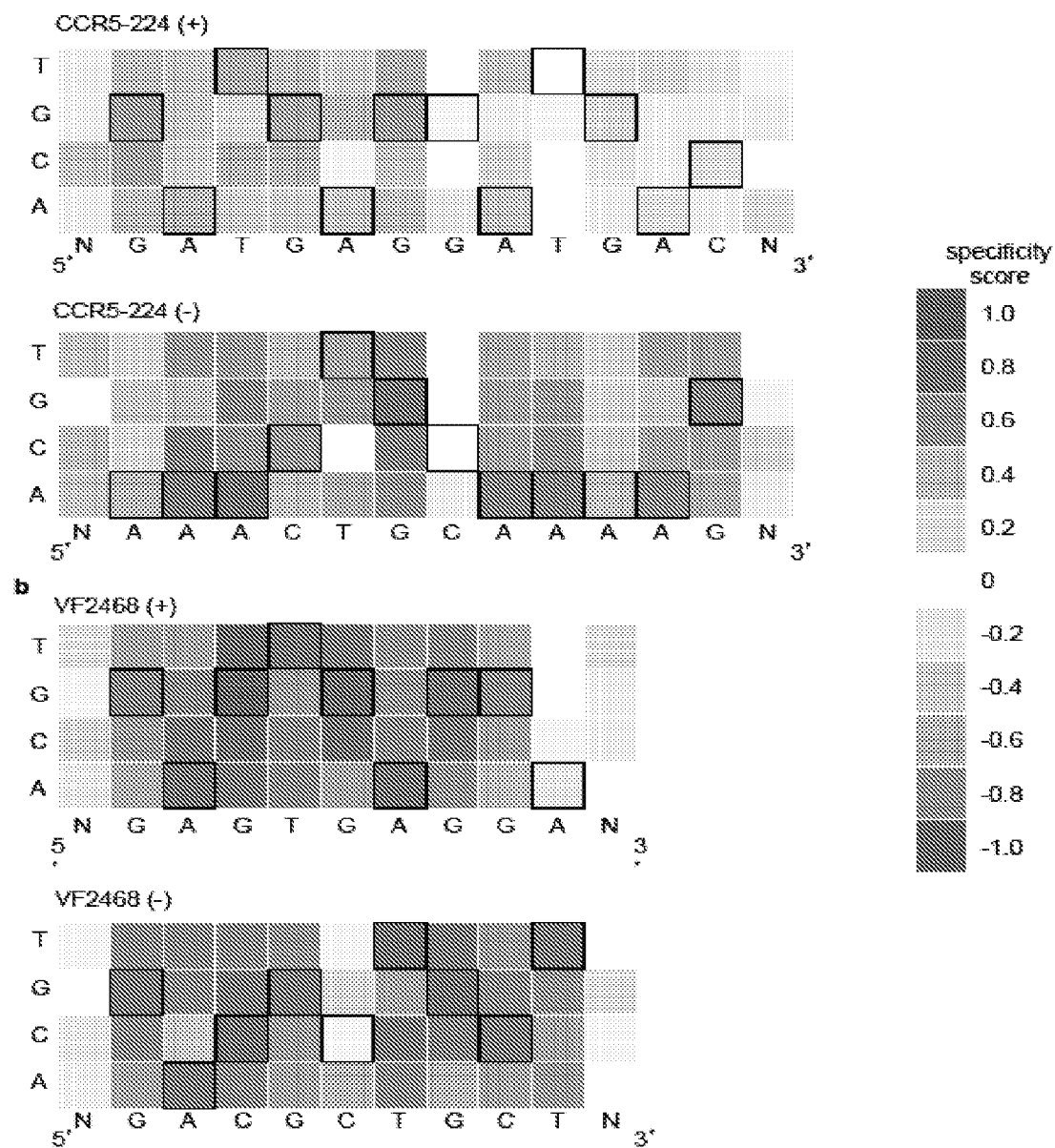
FIG. 2. DNA cleavage sequence specificity profiles for CCR5-224 and VF2468 ZFNs. The heat maps show specificity scores compiled from all sequences identified in selections for cleavage of 14 nM of DNA library with (a) 2 nM CCR5-224 (SEQ ID NOs:1 and 2) or (b) 1 nM VF2468 (SEQ ID NOs:3 and 4). The target DNA sequence is shown below each half-site. Black boxes indicate target base pairs. Specificity scores were calculated by dividing the change in frequency of each base pair at each position in the post-selection DNA pool compared to the pre-selection pool by the maximal possible change in frequency from pre-selection library to post-selection library of each base pair at each position. Blue boxes indicate enrichment for a base pair at a given position, white boxes indicate no enrichment, and red boxes indicate enrichment against a base pair at a given position. The darkest blue shown in the legend corresponds to absolute preference for a given base pair (specificity score=1.0), while the darkest red corresponds to an absolute preference against a given base pair (specificity score=−1.0).
Figure 11:
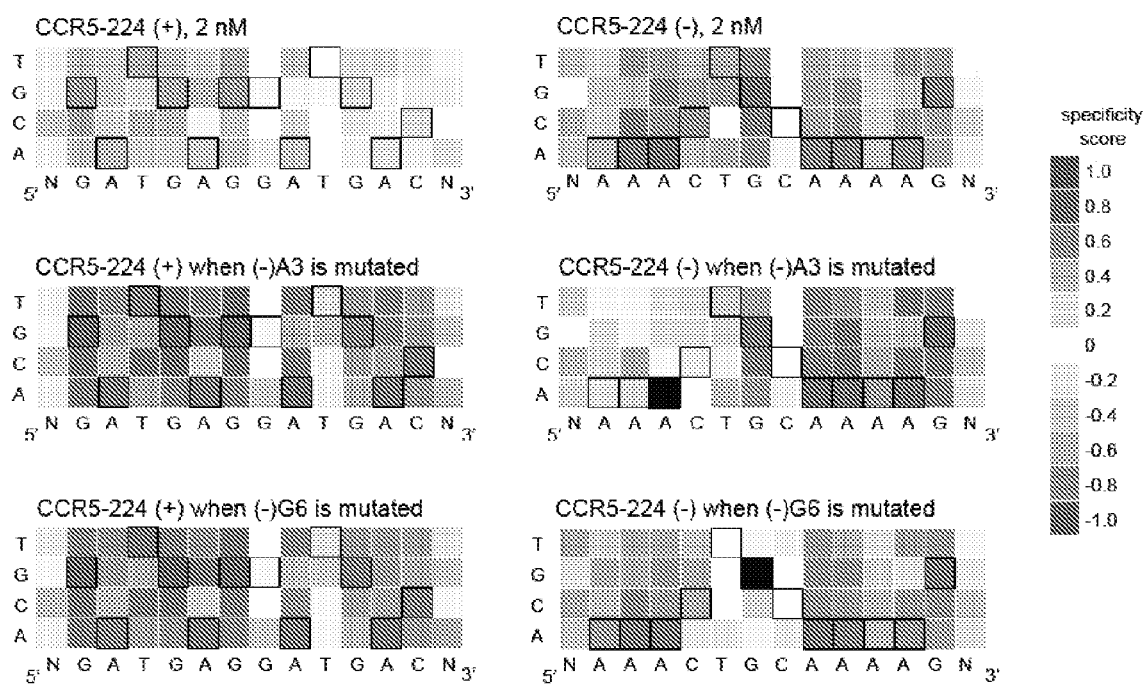
FIG. 11. Stringency at the (+) half-site increases when CCR5-224 cleaves sites with mutations at highly specified base pairs in the (−) half-site. The heat maps show specificity scores for sequences (SEQ ID NOs:29 and 30) identified in the in vitro selection with 2 nM CCR5-224. For (−)A3 and (−)G6, indicated by filled black boxes, both pre-selection library sequences and post-selection sequences were filtered to exclude any sequences that contained an A at position 3 in the (−) half-site or G at position 6 in the (−) half-site, respectively, before specificity scores were calculated. For sites with either (−) half-site mutation, there is an increase in specificity at the (+) half-site. Black boxes indicate target base pairs. Specificity scores were calculated by dividing the change in frequency of each base pair at each position in the post-selection DNA pool compared to the pre-selection pool by the maximal possible change in frequency of each base pair at each position. Blue boxes indicate specificity for a base pair at a given position, white boxes indicate no specificity, and red boxes indicate specificity against a base pair at a given position. The darkest blue shown in the legend corresponds to absolute preference for a given base pair (specificity score=1.0), while the darkest red corresponds to an absolute preference against a given base pair (specificity score=−1.0).

Heat maps of the type described in FIG. 11 are condensed into one line to show only the specificity scores for intended target site nucleotides (in black outlined boxes in FIG. 11). (b) The condensed heat maps are then compared to a condensed heat map corresponding to the unfiltered baseline profile from FIG. 2, to create a condensed difference heat map that shows the relative effect of mutation at the position specified by the white box with black outline on the specificity score profile. Blue boxes indicate an increase in sequence stringency at positions in cleaved sites that contain mutations at the position indicated by the white box, while red boxes indicate a decrease in sequence stringency and white boxes, no change in sequence stringency. The (+) half-site difference map is reversed to match the orientation of the (+) half-site as it is found in the genome rather than as it is recognized by the zinc finger domain of the ZFN.

Figure 13:
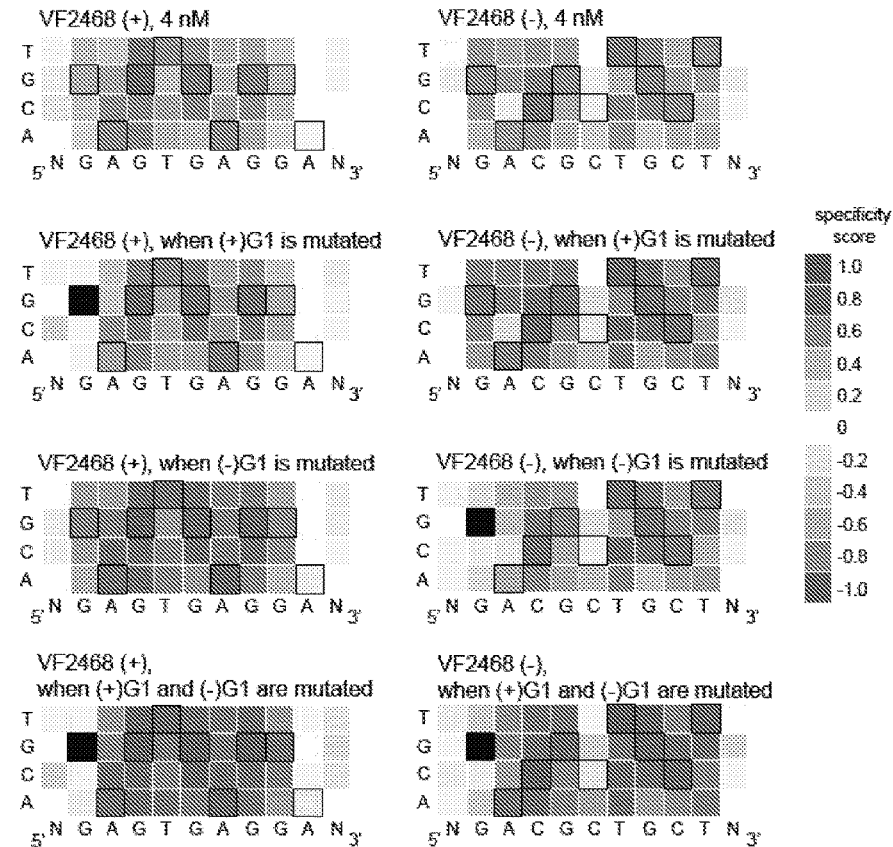

FIG. 13. Stringency at both half-sites increases when VF2468 cleaves sites with mutations at the first base pair of both half-sites. The heat maps show specificity scores for sequences identified in the in vitro selection with 4 nM VF2468. For (+)G1, (−)G1 (SEQ ID NO:40), and (+)G1/(−)G1 (SEQ ID NO:41), indicated by filled black boxes, both pre-selection library sequences and post-selection sequences were filtered to exclude any sequences that contained an G at position 1 in the (+) half-site and/or G at position 1 in the (−) half-site, before specificity scores were calculated. For sites with either mutation, there is decrease in mutational tolerance at the opposite half-site and a very slight decrease in mutational tolerance at the same half-site. Sites with both mutations show a strong increase in stringency at both half-sites. Black boxes indicate on-target base pairs. Specificity scores were calculated by dividing the change in frequency of each base pair at each position in the post-selection DNA pool compared to the pre-selection pool by the maximal possible change in frequency of each base pair at each position. Blue boxes indicate specificity for a base pair at a given position, white boxes indicate no specificity, and red boxes indicate specificity against a base pair at a given position. The darkest blue shown in the legend corresponds to absolute preference for a given base pair (specificity score=1.0), while the darkest red corresponds to an absolute preference against a given base pair (specificity score=−1.0).

Figure 14:
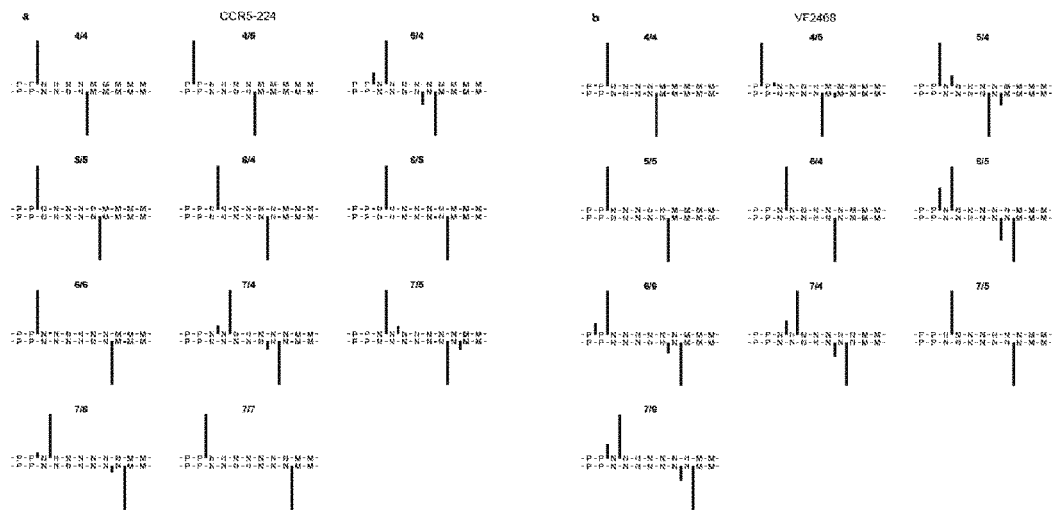

FIG. 14. ZFN cleavage occurs at characteristic locations in the DNA target site. The plots show the locations of cleavage sites identified in the in vitro selections with (a) 4 nM CCR5-224 or (b) 4 nM VF2468. The cleavage site locations show similar patterns for both ZFNs except in the case of five-base pair spacers with four-base overhangs. The titles refer to the spacer length/overhang length combination that is plotted (e.g., a site with a six base-pair spacer and a four base overhang is referred to as "6/4"). The black bars indicate the relative number of sequences cleaved for each combination of spacer length and overhang length. 'P' refers to nucleotides in the (+) target half-site, 'M' refers to nucleotides in the (−) target half site, and 'N' refers to nucleotides in the spacer. There were no "7/7" sequences from the 4 nM VF2468 selection. Only sequences with overhangs of at least 4 bases were tabulated.

Figure 15:
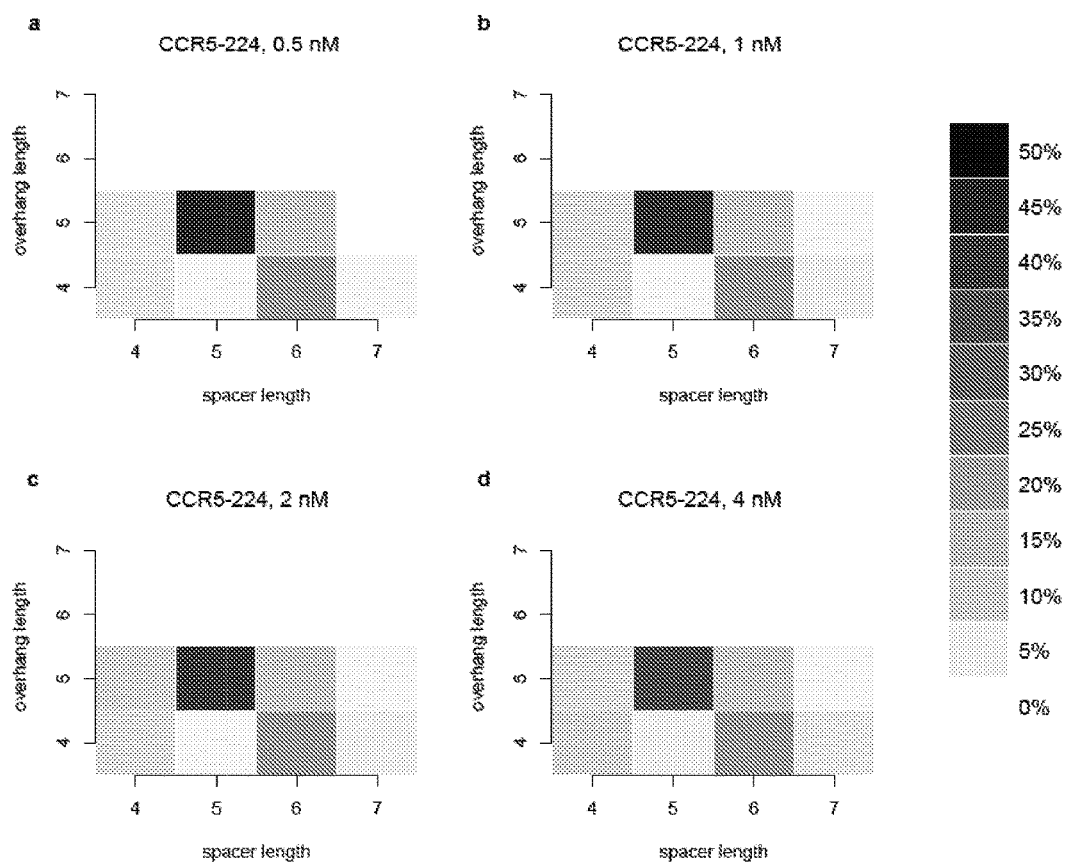

FIG. 15. CCR5-224 preferentially cleaves five- and six-base pair spacers and cleaves five-base pair spacers to leave five-nucleotide overhangs. The heat maps show the percentage of all sequences surviving each of the four CCR5-224 in vitro selections (a-d) that have the spacer and overhang lengths shown.

Figure 16:
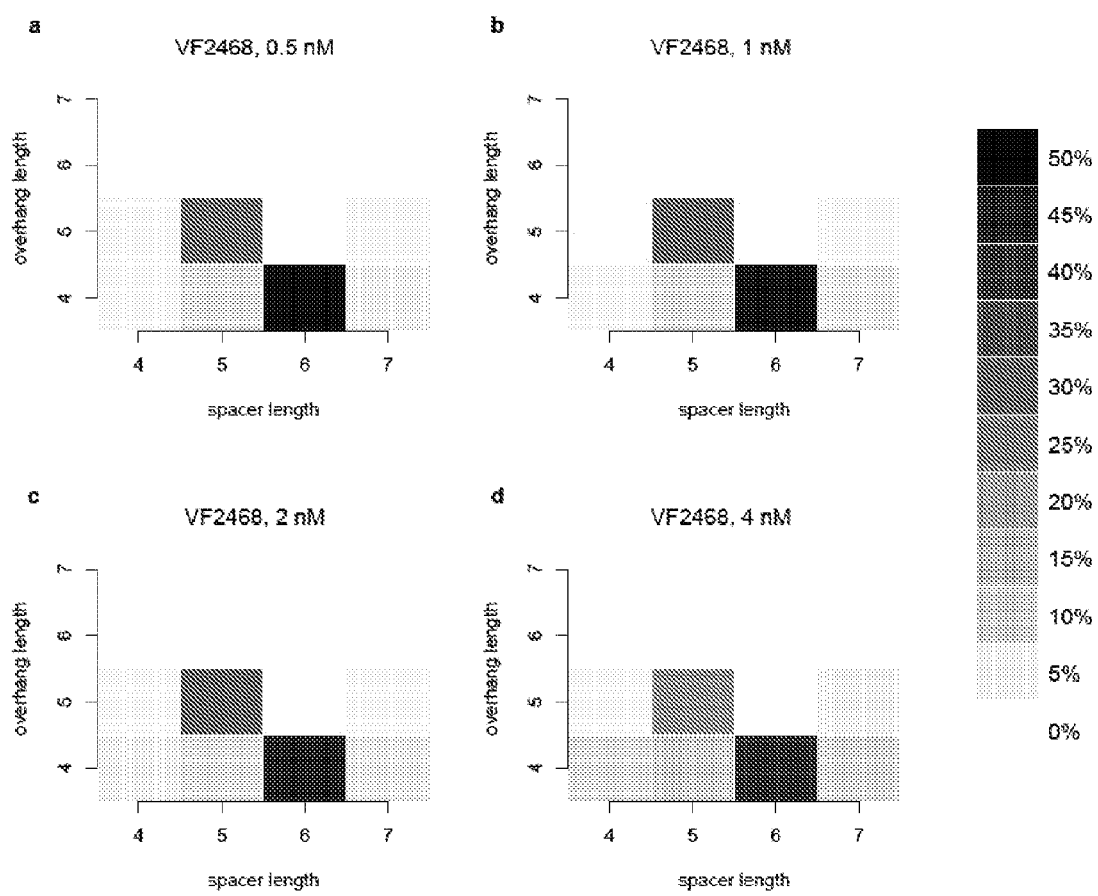

FIG. 16. VF2468 preferentially cleaves five- and six-base pair spacers, cleaves five-base pair spacers to leave five-nucleotide overhangs, and cleaves six-base pair spacers to leave four-nucleotide overhangs. The heat maps show the percentage of all sequences surviving each of the four VF2468 in vitro selections (a-d) that have the spacer and overhang lengths shown.

Figure 17:
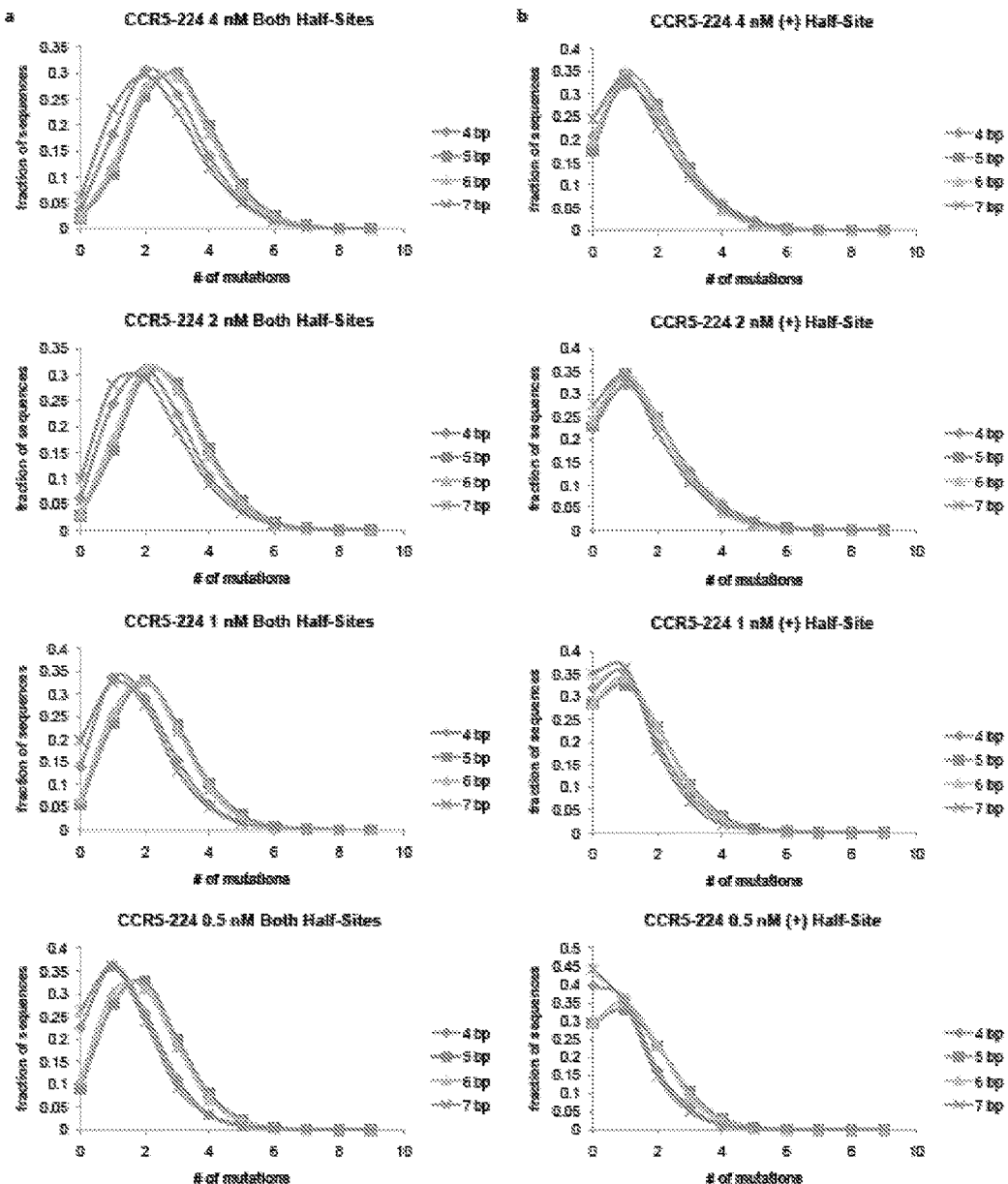
Figure 17:
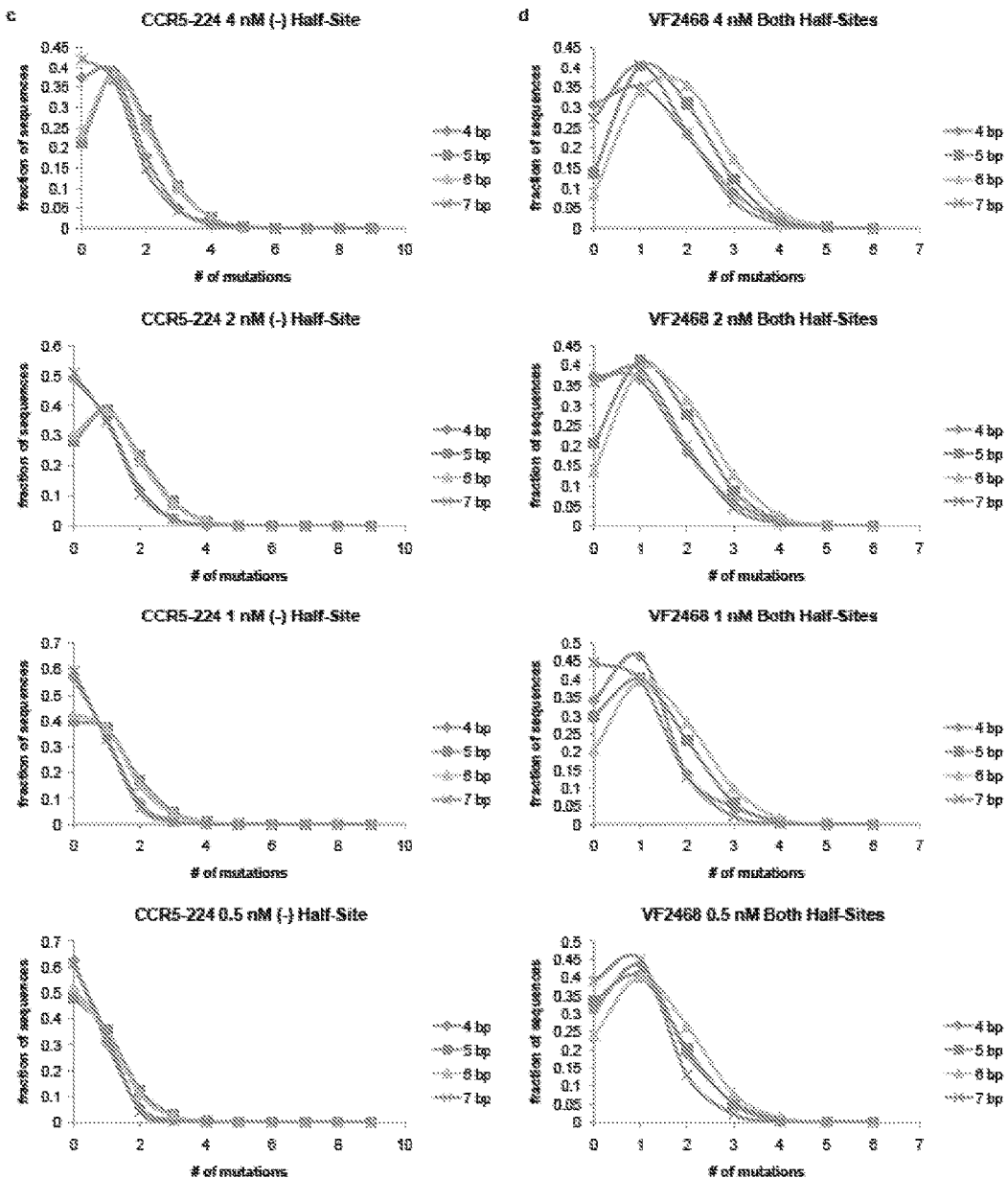
Figure 17:
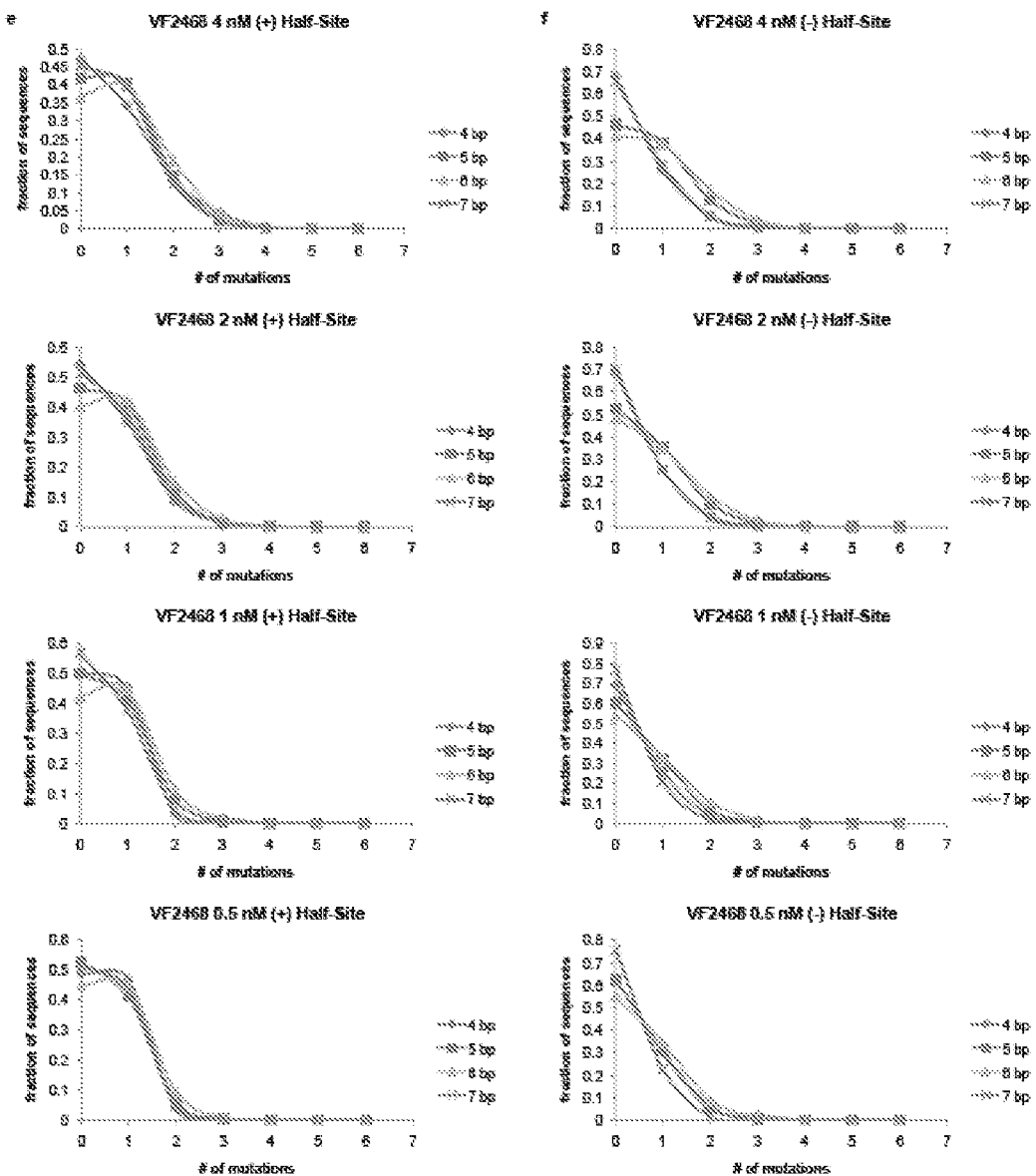

FIG. 17. ZFNs show spacer length-dependent sequence preferences. Both CCR5-224 (a-c) and VF2468 (d-f) show increased specificity for half-sites flanking four- and seven-base pair spacers than for half-sites flanking five- and six-base pair spacers. For both ZFNs, one half-site has a greater change in mutational tolerance than the other, and the change in mutational tolerance is concentration dependent.

Figure 18:
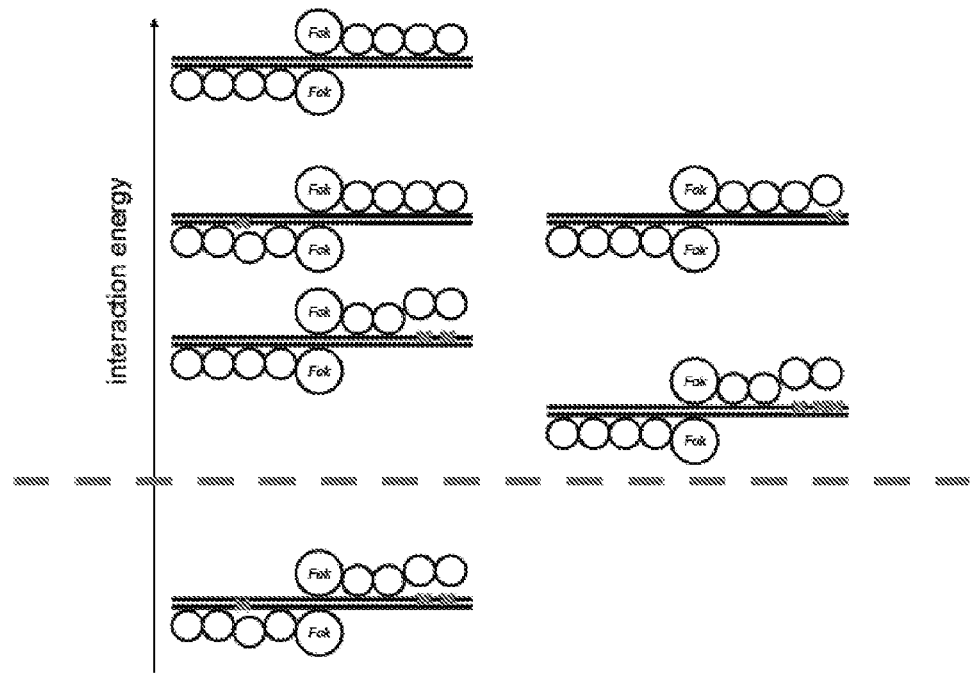

FIG. 18. Model for ZFN tolerance of off-target sequences. Our results suggest that some ZFNs recognize their intended target sites (top, black DNA strands with no Xs) with more binding energy than is required for cleavage under a given set of conditions (dotted line). Sequences with one or two mutations (one or two Xs) are generally tolerated since they do not decrease the ZFN:DNA binding energy below the threshold necessary for cleavage. Some sequences with additional mutations can still be cleaved if the additional mutations occur in regions of the zinc-finger binding interface that have already been disrupted (three Xs above the dotted line), as long as optimal interactions present at other locations in the ZFN:DNA binding interface maintain binding energies above threshold values. Additional mutations that disrupt key interactions at other locations in the ZFN:DNA interface, however, result in binding energies that fall short of the cleavage threshold.

Figure 19:
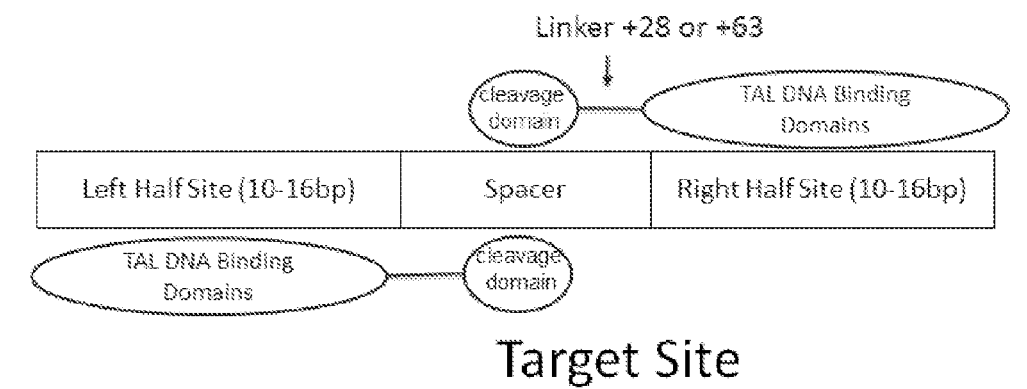

FIG. 19. Profiling The Specificity of TAL Nucleases. Selection 1: +28 vs. +63 aa Linker Between TAL DNA Binding Domain and Fok1 Cleavage Domain (SEQ ID NOs:42-45).

Figure 20:
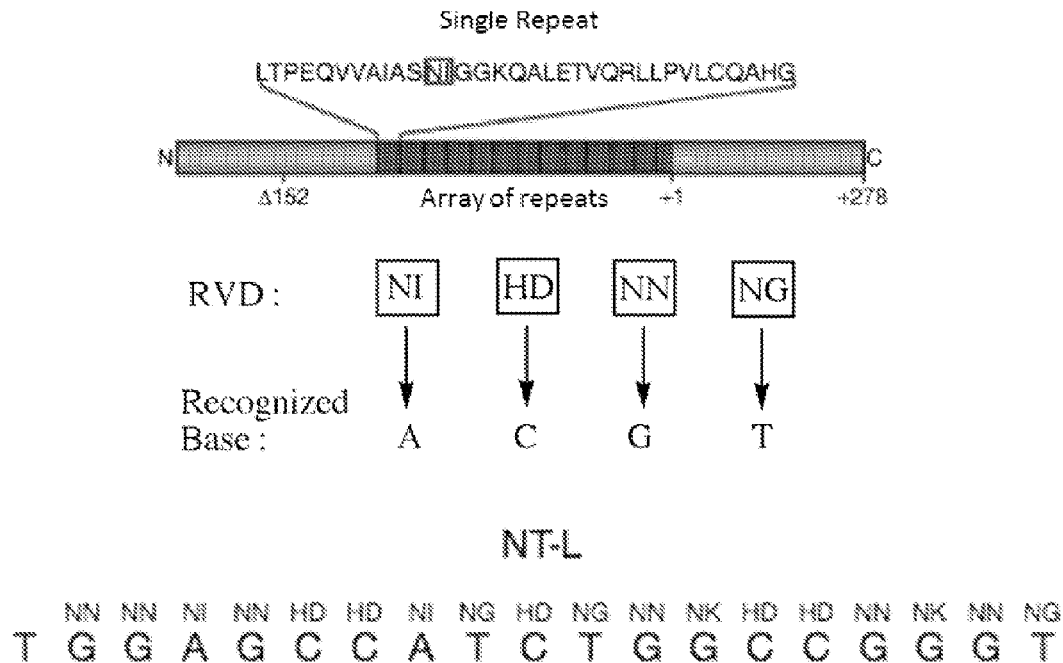

FIG. 20. Structure of TAL DNA binding domain and RVDs (SEQ ID NOs:46 and 47).

Figure 21:
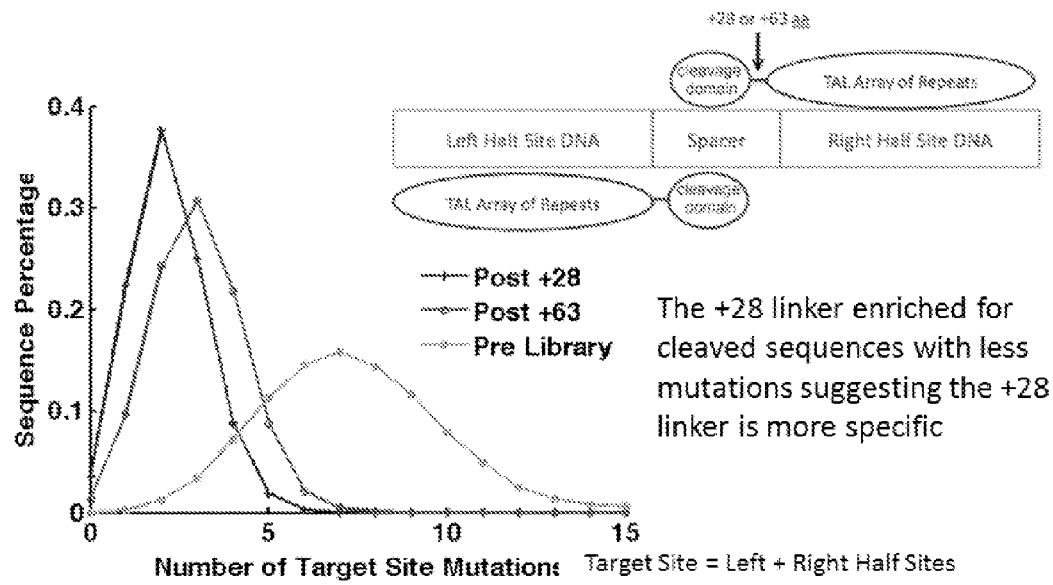
Figure 22:
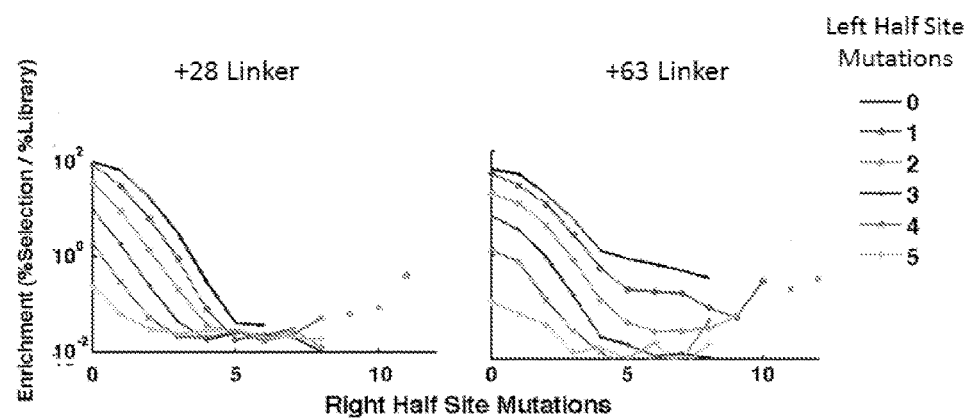

FIG. 21. Mutations in target sites from TALN selection. The +28 linker enriched for cleaved sequences with less mutations suggesting the +28 linker is more specific. There are significantly less mutations in the post-selected sequences compared to the pre-selection library sequences indicating a successful selection FIG. 22. Enrichment of Mutations in Total Target Site Between Left and Right Half Sites of Previous TALN Selection. The relatively regular (log relationship) trend between number of half sites mutations and enrichment is consistent with a single repeat binding a base pair independent of other repeat binding.

Figure 23:
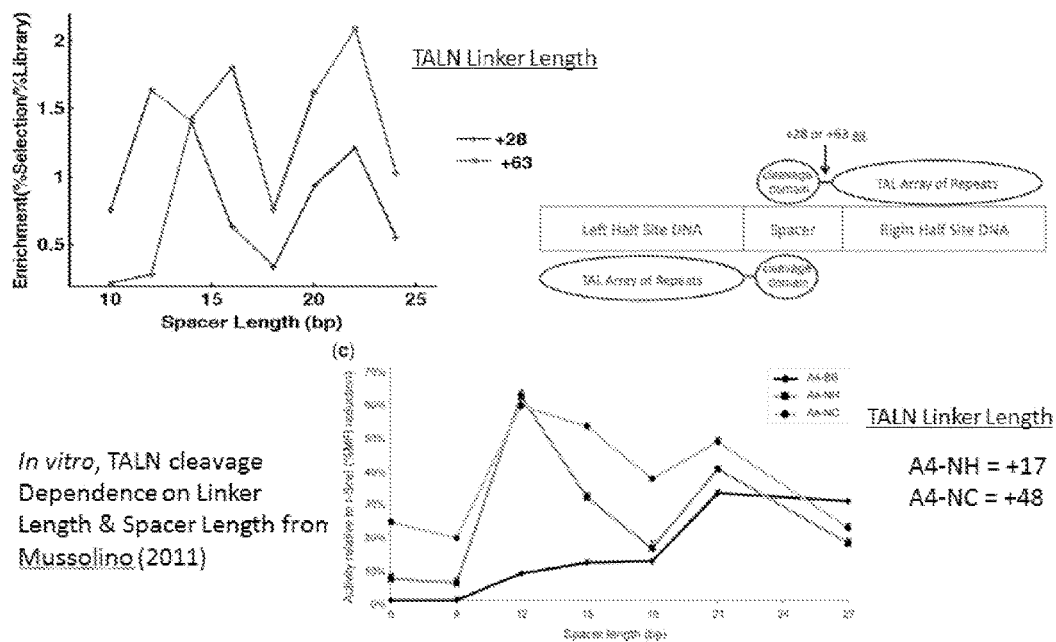

FIG. 23. TALN Cleavage Dependence on DNA Spacer Length. There is a similar preference for cut site spacer lengths in our in vitro selection compared to previous studies. In vitro. TALN cleavage. Dependence on Linker Length & Spacer Length from Mussolino (2011).

Figure 24:
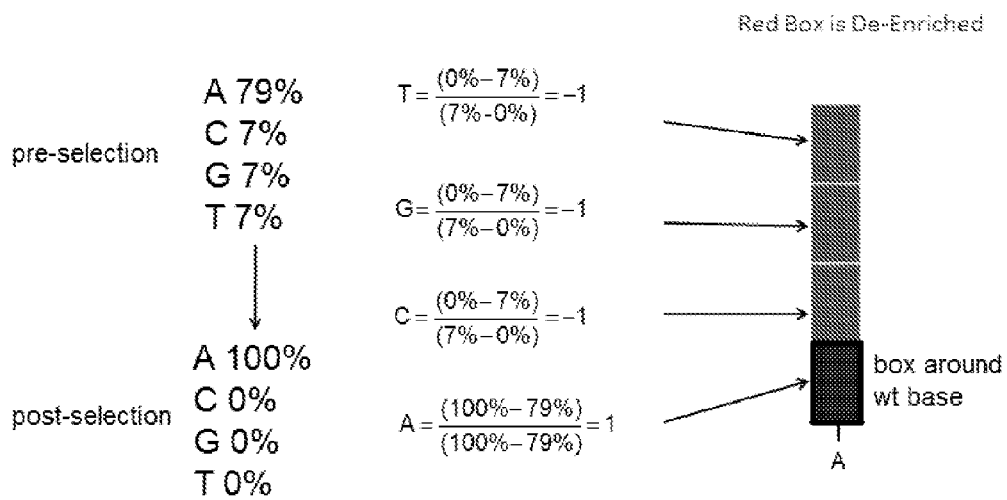

FIG. 24. Specificity score at individual bases.

Figure 25:
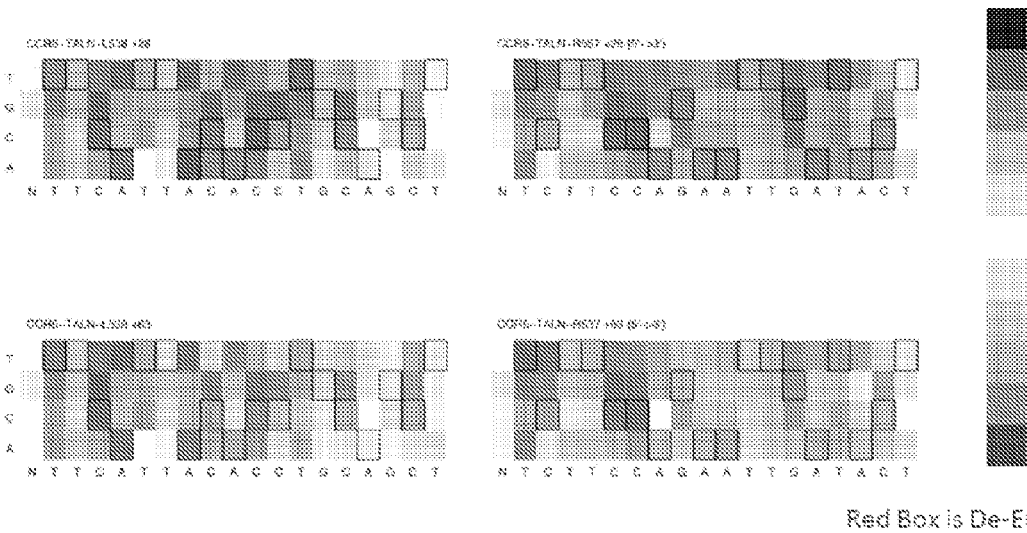

FIG. 25. Specificity score at individual bases. There is variable specificity at each individual position again with +28 linker demonstrating significantly better specificity (SEQ ID NOs:48 and 49).

Figure 26:
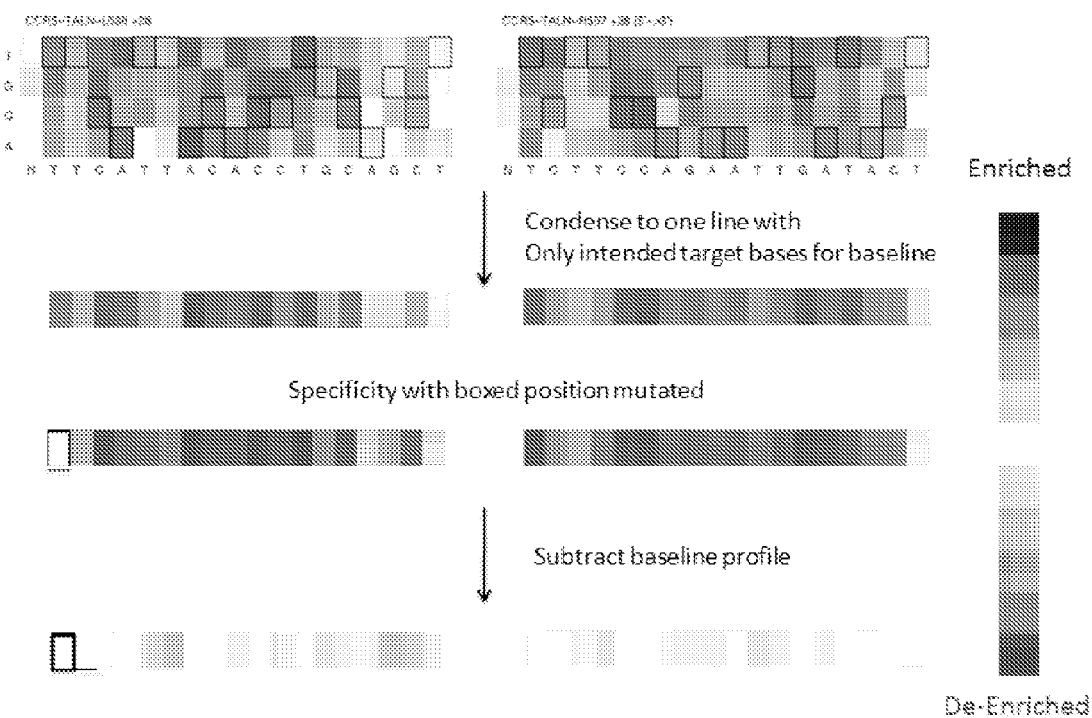

FIG. 26. Compensating Difference in Specificity of TALNs Analysis (SEQ ID NOs:50-51).

Figure 27:
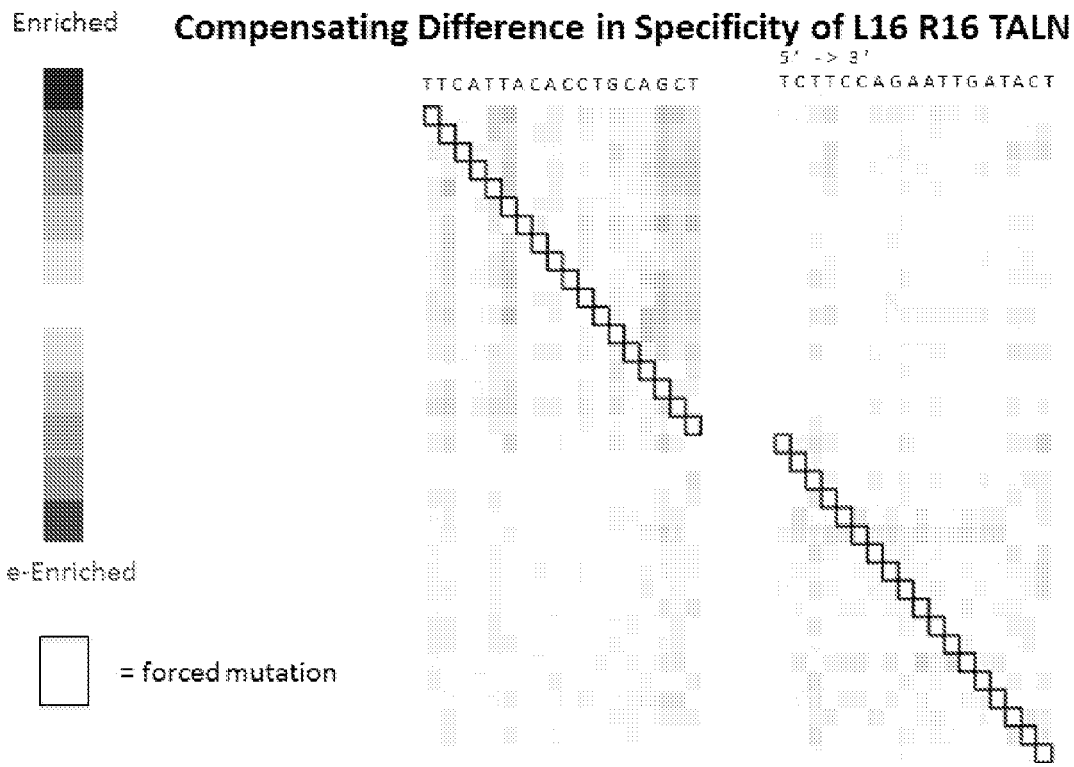

FIG. 27. Compensating Difference in Specificity of L16 R16 TALN. A single mutation in the cleavage site does not alter the distribution of other mutations suggesting that the TAL repeat domains bind independently (SEQ ID NOs:52-53).

Figure 28:
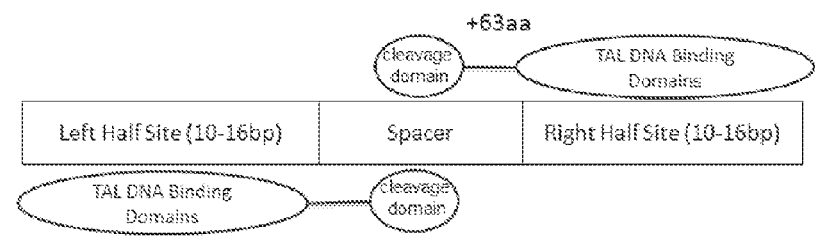

FIG. 28. Profiling the Specificity of TALNs Selection II: Varying TALN Lengths (SEQ ID NOs:54-61).

Figure 29:
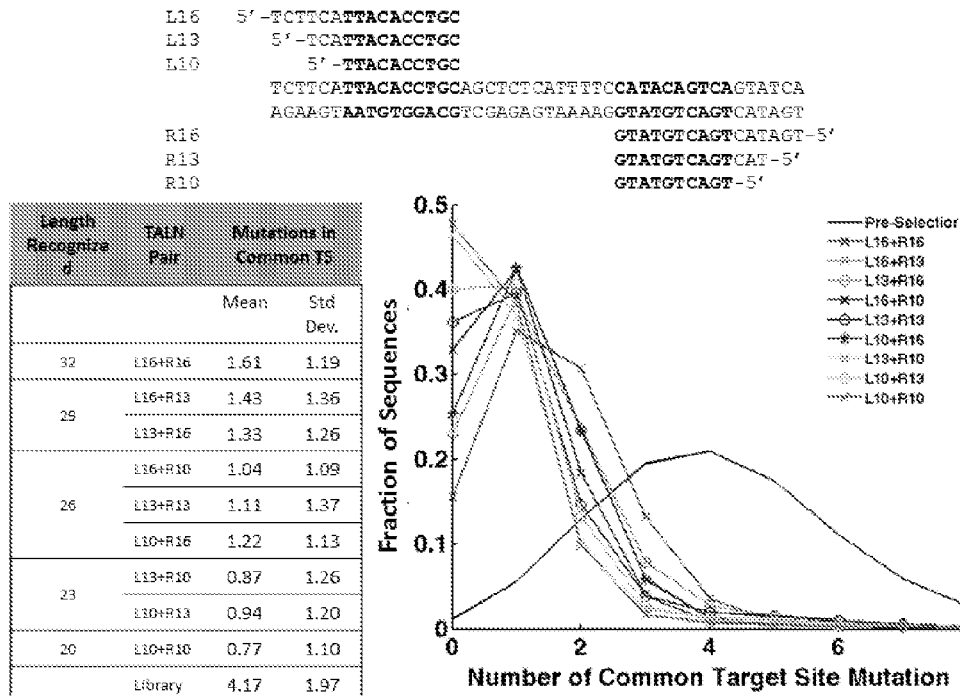

FIG. 29. Enrichment of Mutations in Common Target Site (SEQ ID NOs:62-69).

Figure 30:
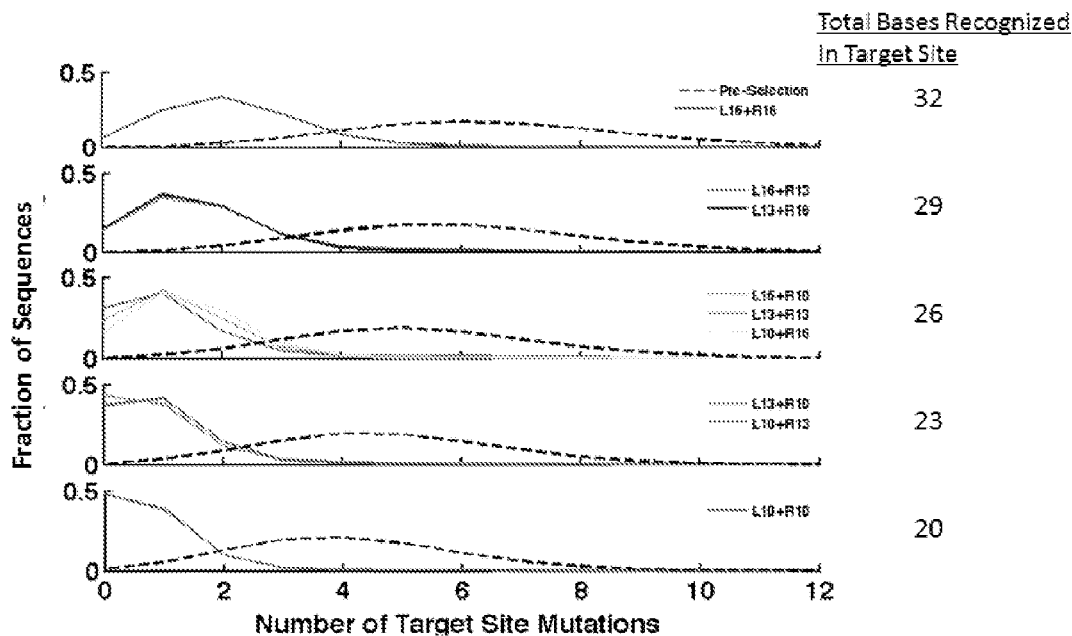

FIG. 30. Distribution of Mutations in Total Targeted Site of TALN Digestion vs. Pre-Selection Library.

Figure 31:
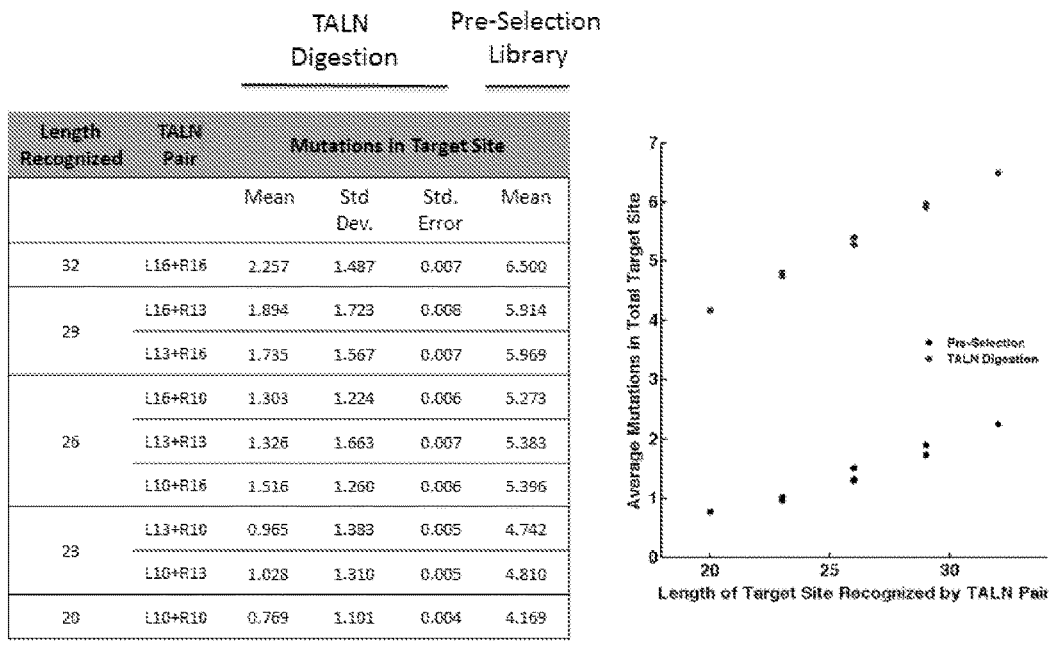

FIG. 31. Distribution of Mutations in Total Targeted Site of TALN Digestion vs. Pre-Selection Library.

Figure 32:
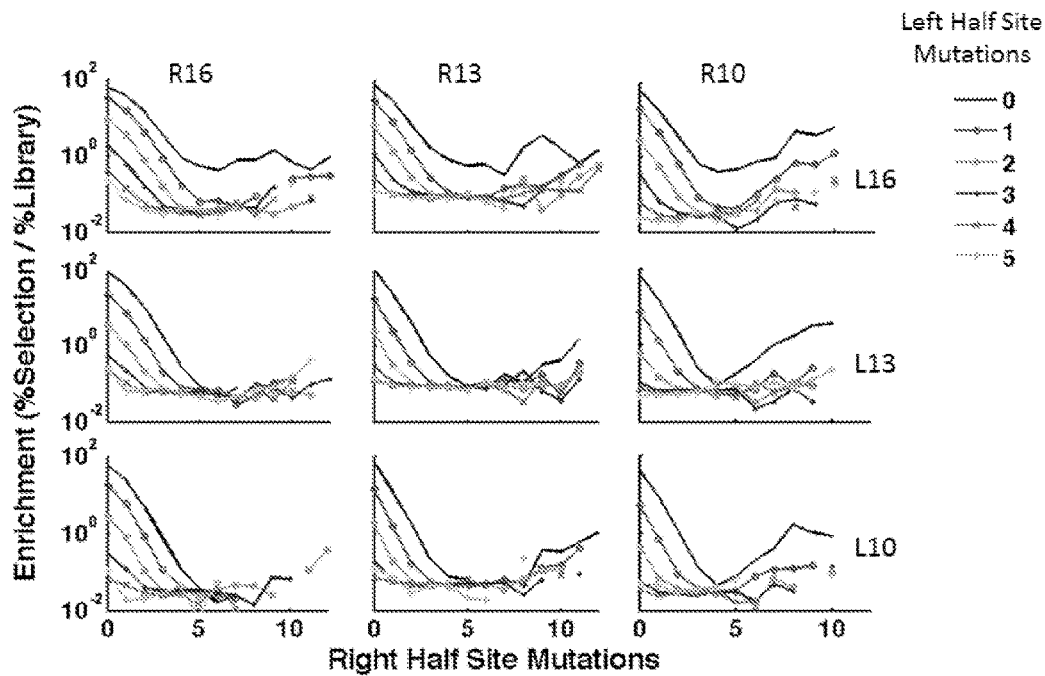

FIG. 32. Enrichment of Mutations in Total Target Site Between Right and Left Half Sites of TALN Pairs.

Figure 33:
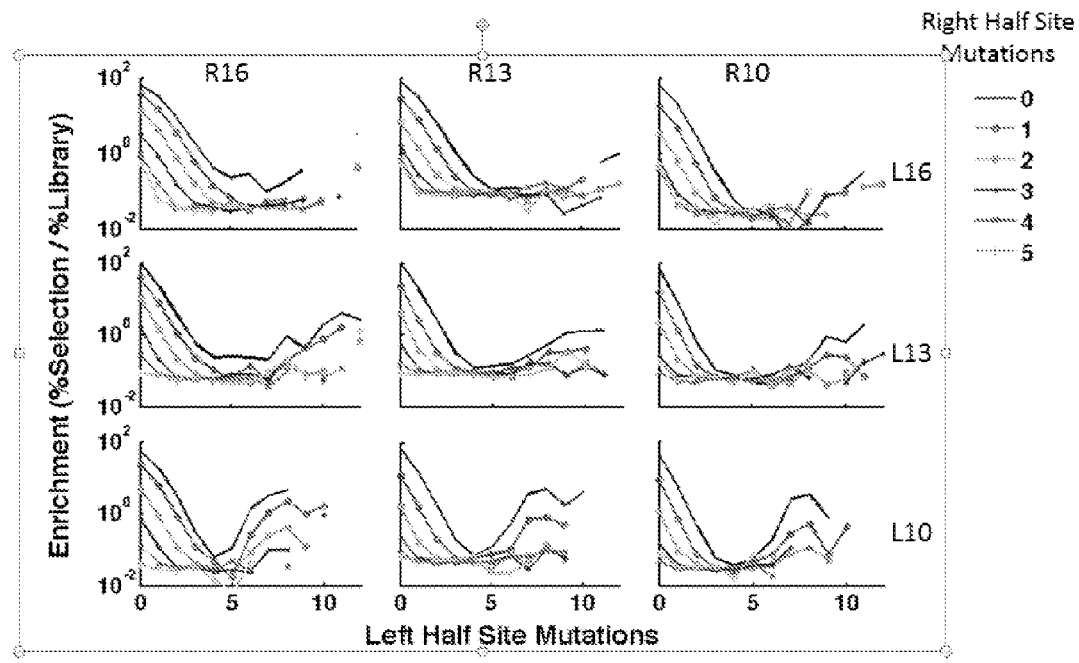

FIG. 33. Enrichment of Mutations in Total Target Site Between Right and Left Half Sites of TALN Pairs.

Figure 34:
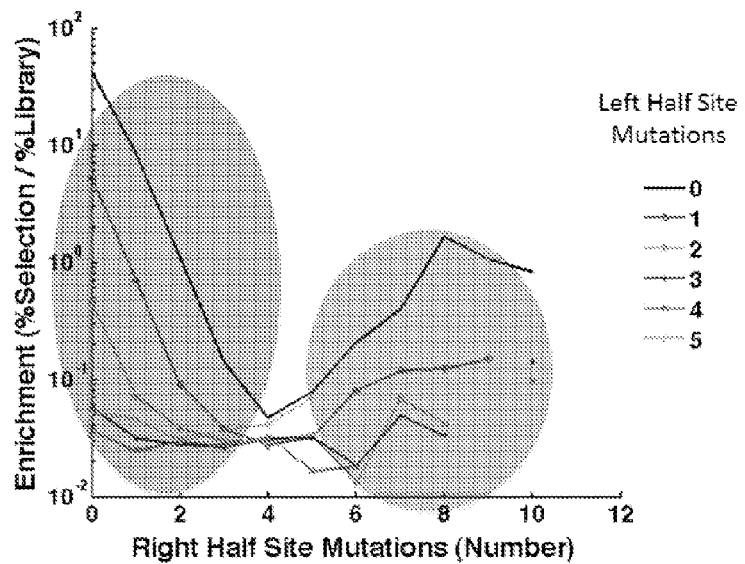

FIG. 34. Enrichment of Mutations in Total Targeted Site of TALN Digestion vs. Pre-Selection Library for L10 R10 TALN Pair.

Figure 35:
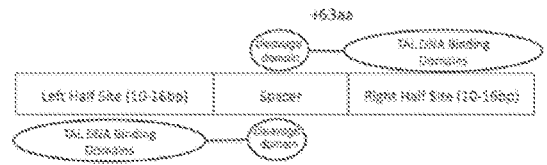
Figure 35:
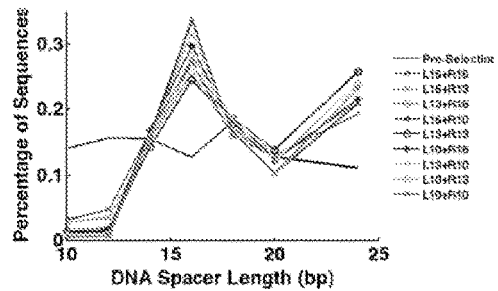
Figure 35:
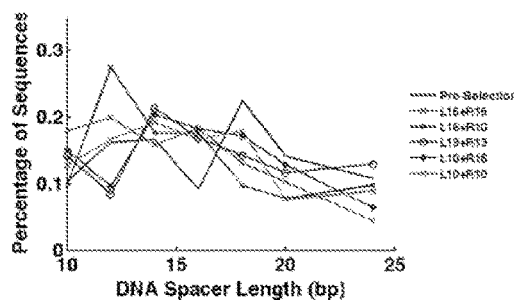

FIG. 35. DNA spacer profile. While the vast majority of sequences have a spacer preference, the highly mutant sequences have no significant spacer preference as might be expected from alternate frames changing the spacer length.

Figure 36:
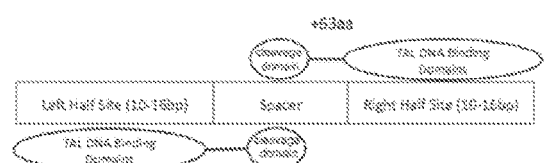
Figure 36:
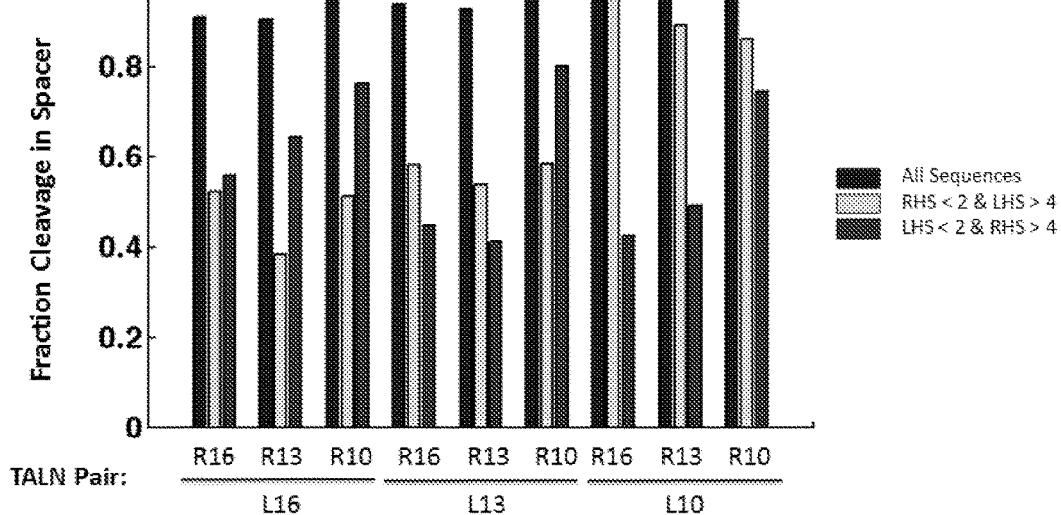

FIG. 36. Cleavage point profile. While the vast majority of sequences are cut in the spacer as expected, the R16 L16 highly mutant sequences are not predominately cut in spacer but the L10 R10 ones are cut in the spacer possibly indicative of a frame-shifted binding site leading to productive spacer cutting.

Figure 37:
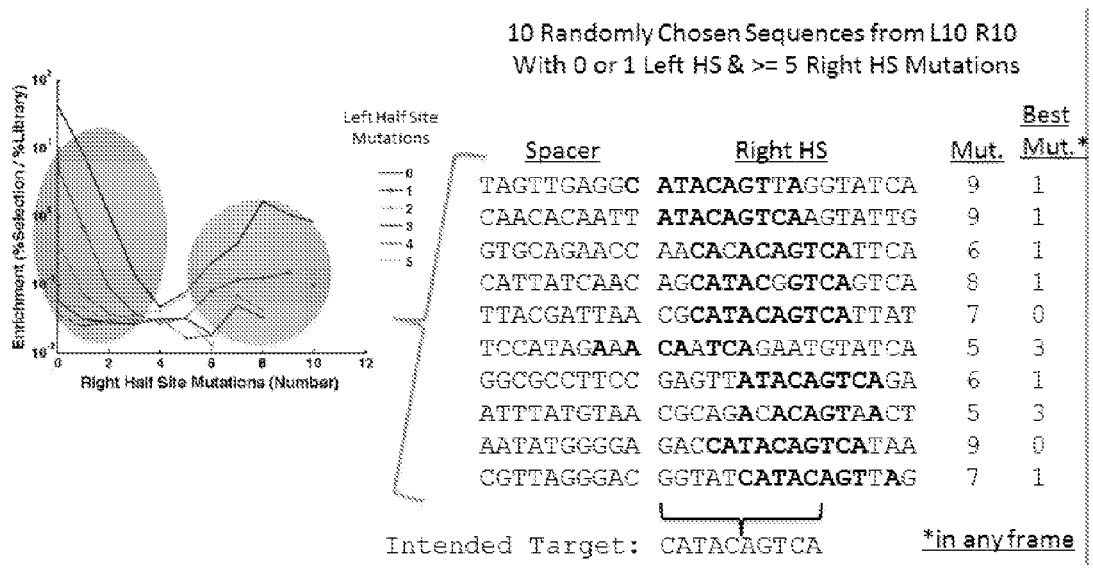

FIG. 37. Highly Mutant Half Sites in L10 R10 TALN Pair. Many potential binding sites in frames outside of the intended frame have sites more similar to the intended target (SEQ ID NOs:70-90).

Figure 38:
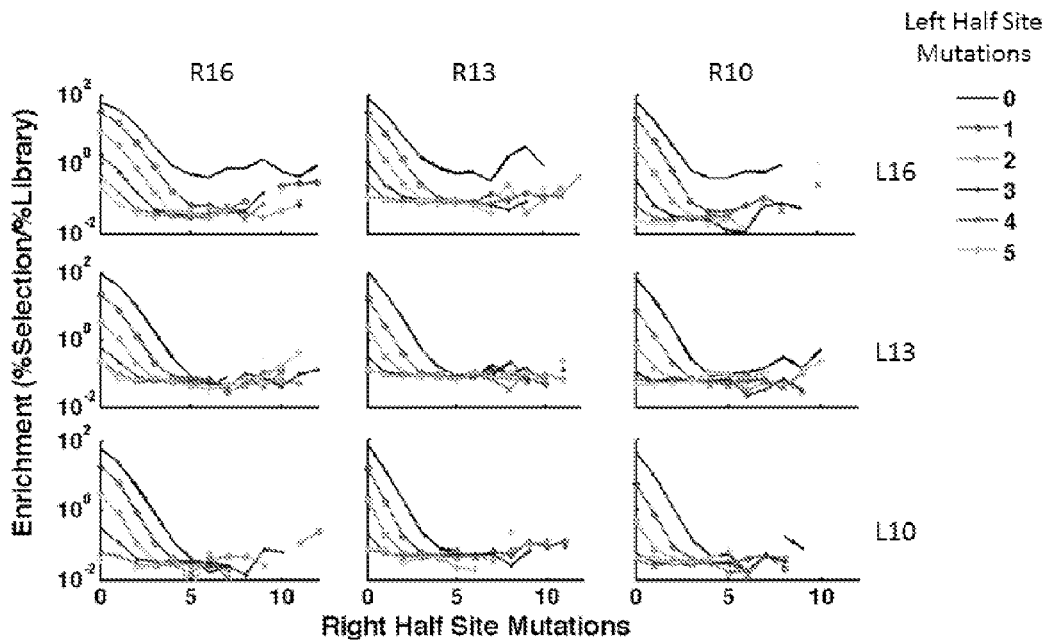

FIG. 38. Enrichment of Mutations in Total Target Site Between Left and Right Half Sites of TALN Pairs Edited for Frame-shifted Binding Sites.

Figure 39:
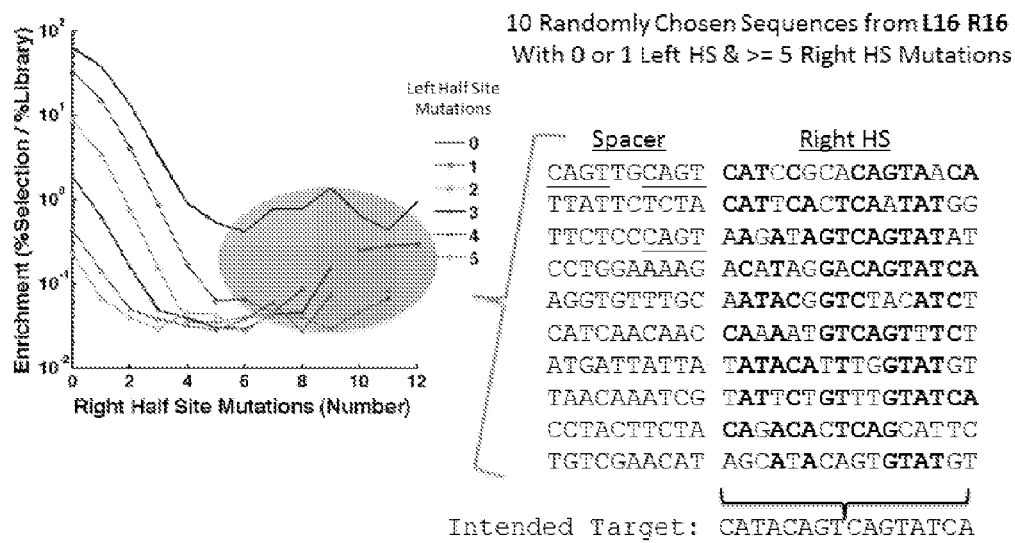

FIG. 39. Highly Mutant Half Sites in L16 R16 TALN Pair (SEQ ID NOs:91-111).

Figure 40:
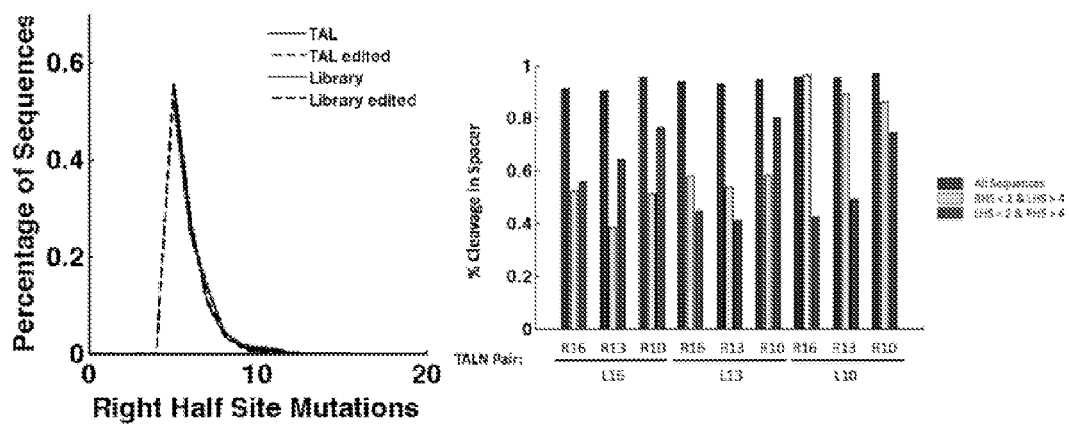

FIG. 40. Highly Mutant Half Sites in L16 R16 TALN Pair. The highly mutant sequences from L16 R16 cannot be explained by a frame-shift (left figure), have no DNA Spacer preference (see slide 11) and seem to be cutting more often outside of the DNA Spacer (right figure) indicating perhaps homodimer cleavage (even with heterodimer) or heterodimer cleavage independent of a TAL domain binding target site DNA (i.e. dimerization through the Fok1 cleavage domain).

Figure 41:
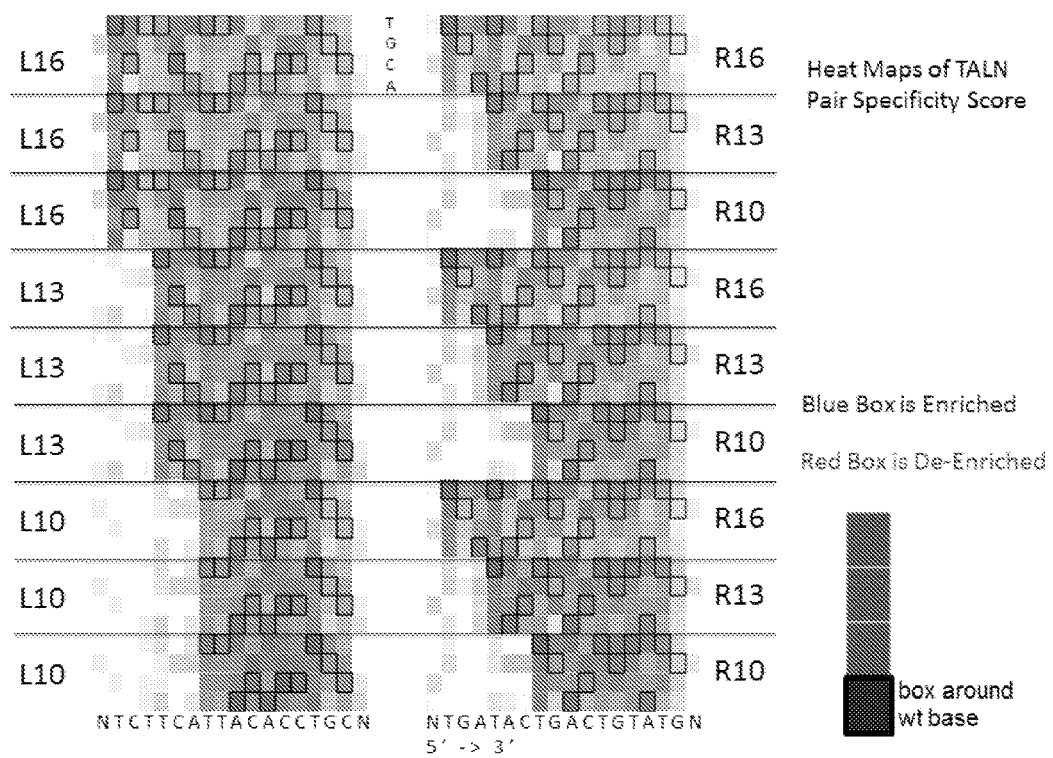

FIG. 41. Heat Maps of TALN Pair Specificity Score (SEQ ID NOs:112 and 113).

Figure 42:
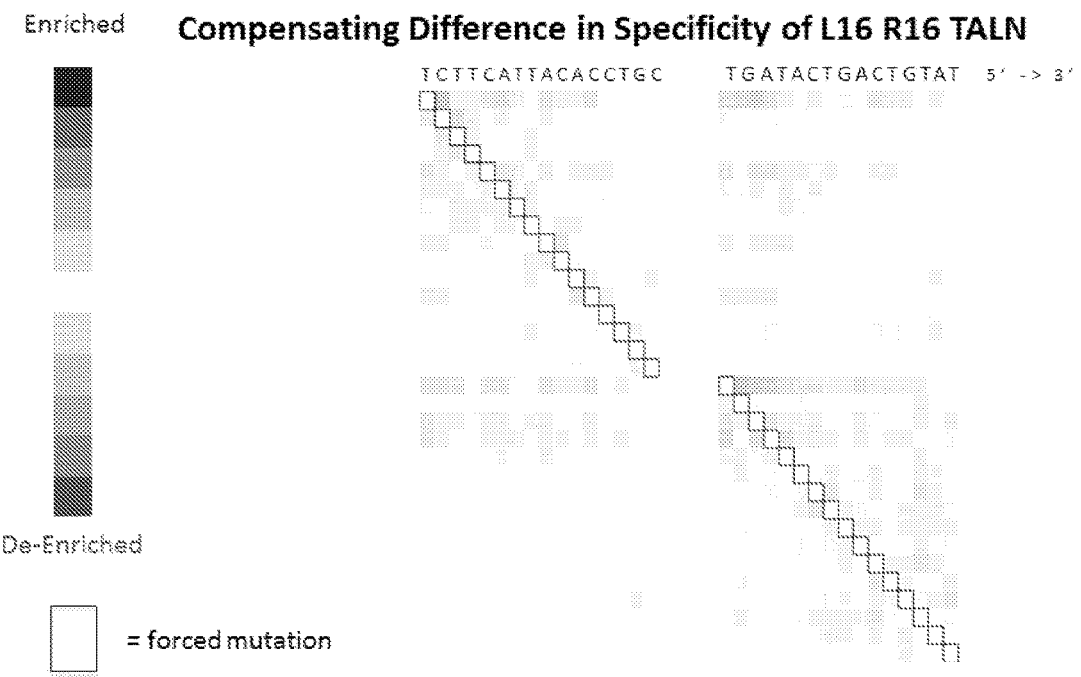

FIG. 42. Compensating Difference in Specificity of L16 R16 TALN. A single mutation in the cleavage site does not alter the distribution of other mutations suggesting that the TAL repeat domains bind independently (SEQ ID NOs:114 and 115).

Figure 43:
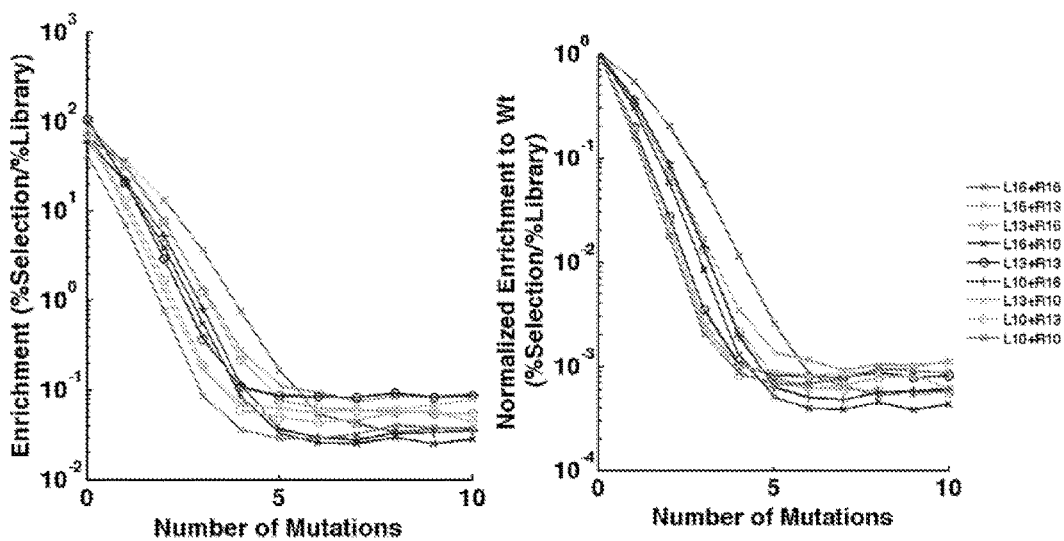

FIG. 43. Enrichment of Mutations in Full, Total Target Site of TALN Pairs. The enrichments seem to have similar log slopes in the low mutation range, the selections containing a TALN recognizing 16 bps seem to be the exceptions indicating R16 binding may be saturating for some very low mutation sites (aka R16 & L16 were near or above the Kd for the wild type site).

Figure 44:
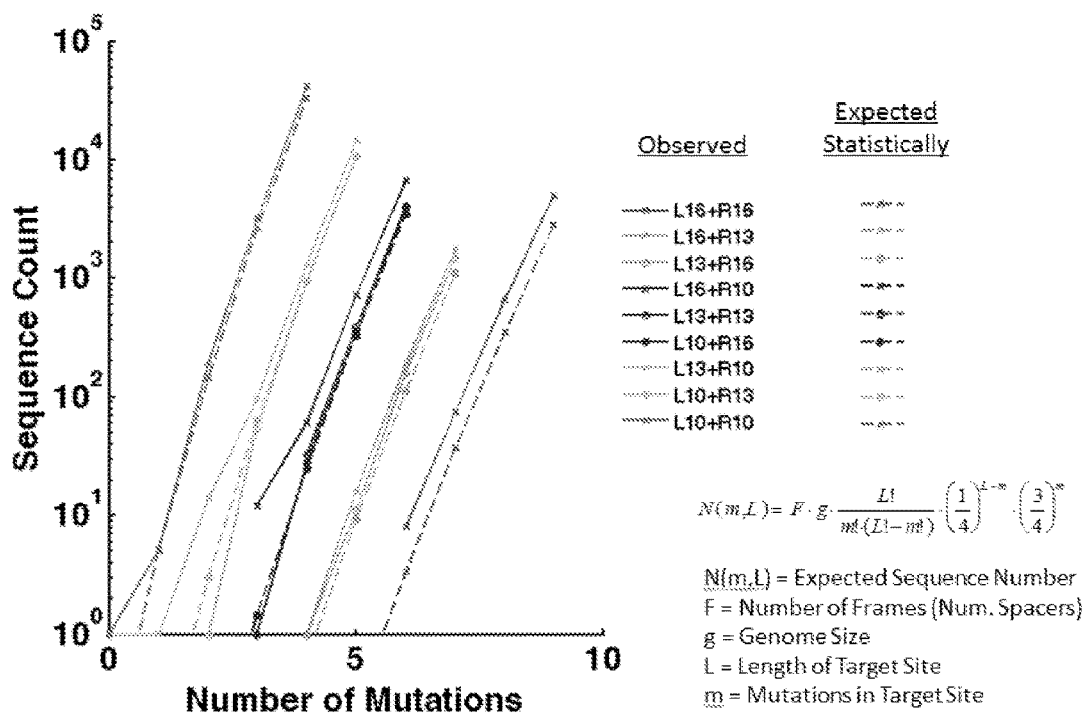

FIG. 44. TALN Off-Target Sites in the Human Genome.

Figure 45:
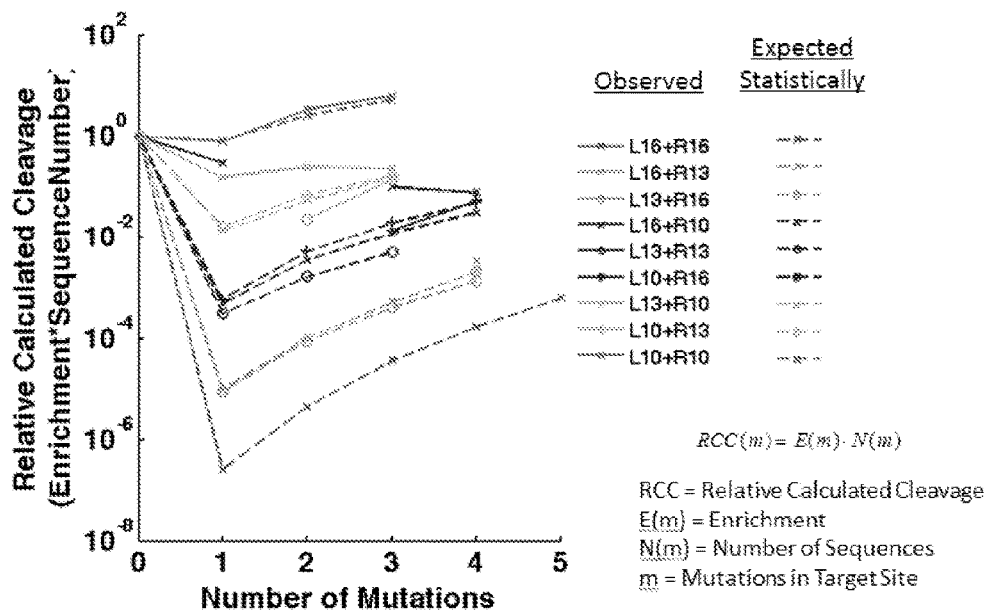

FIG. 45. TALN Off-Target Sites Predicted Cleavage.

Figure 46:
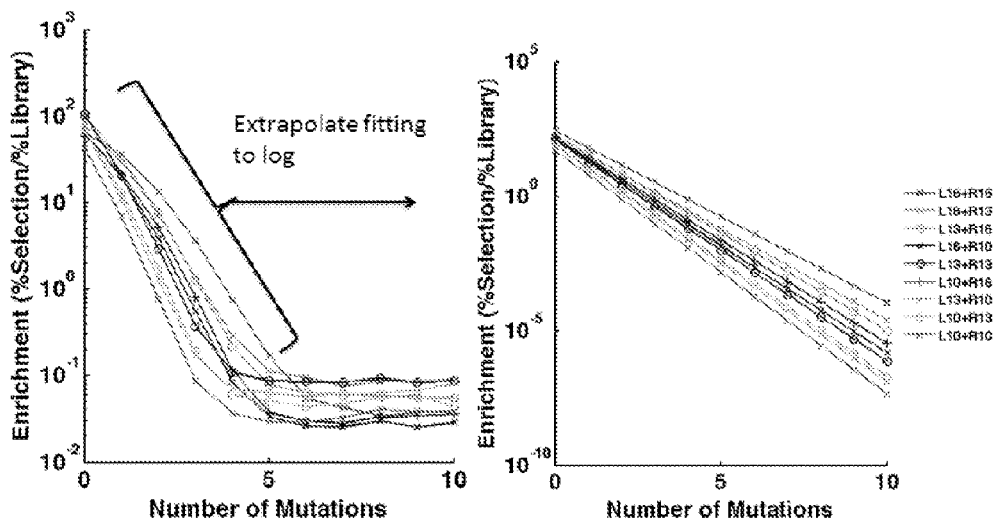

FIG. 46. TALN Off-Target Sites Predicted Cleavage For Very Mutant Target Sites below Detection Limit.

Figure 47:
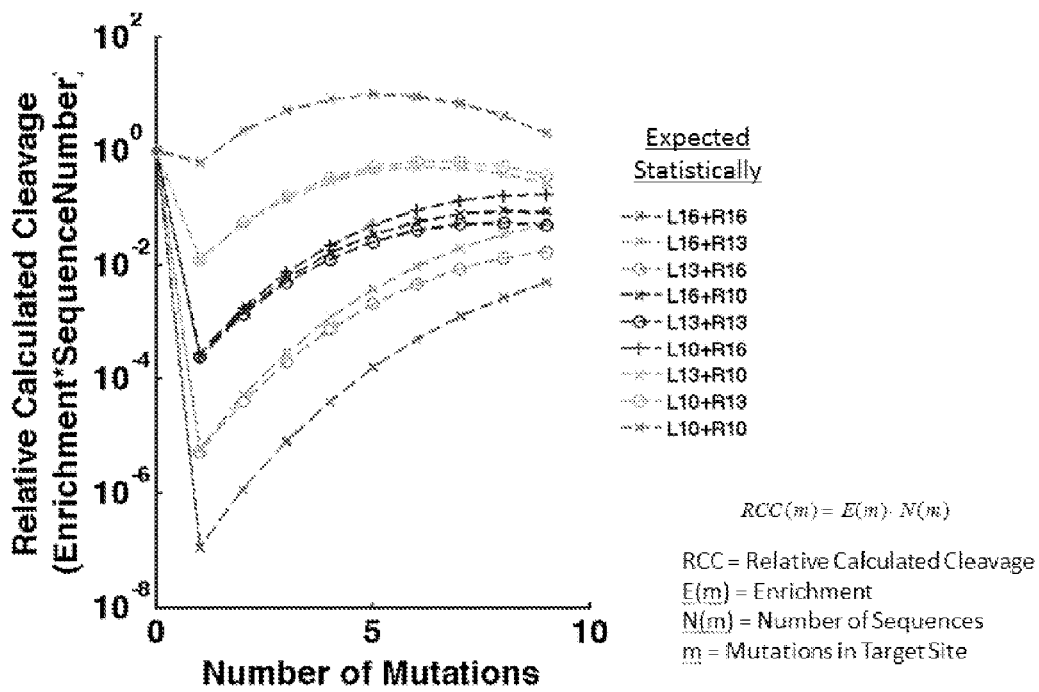

FIG. 47. TALN Off-Target Sites Predicted Cleavage For Very Mutant Target Sites below Detection Limit.

Figure 48:
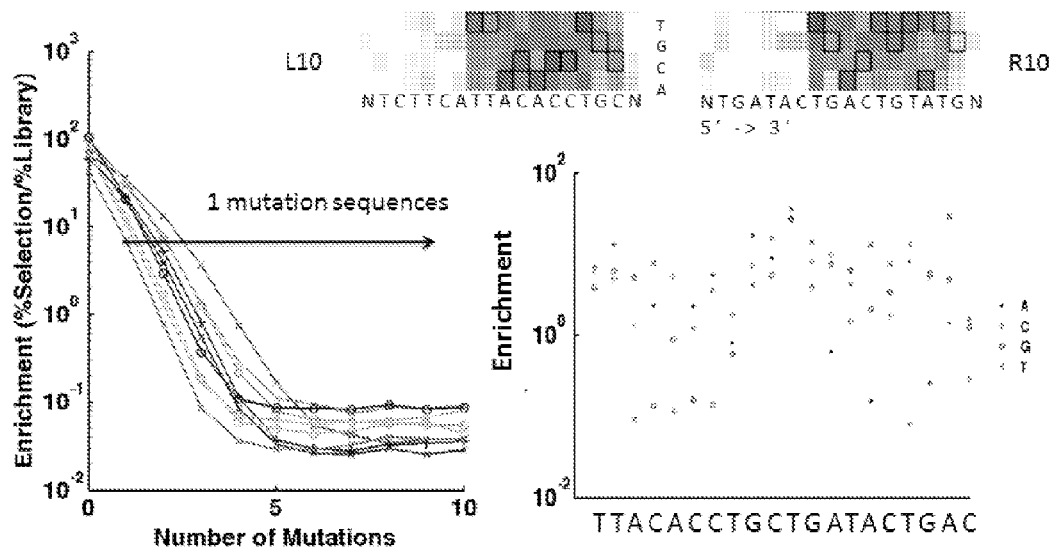

FIG. 48. TALN Off-Target Sites Predicted Cleavage For Sequences (Not just Number of Mutations). Combining the regular log decrease of cleavage efficiency (enrichment) as total target site mutations increase and the enrichment at each position we should be able to predict the off-target site cleavage of any sequence (SEQ ID NOs:116-118).

Figure 49:
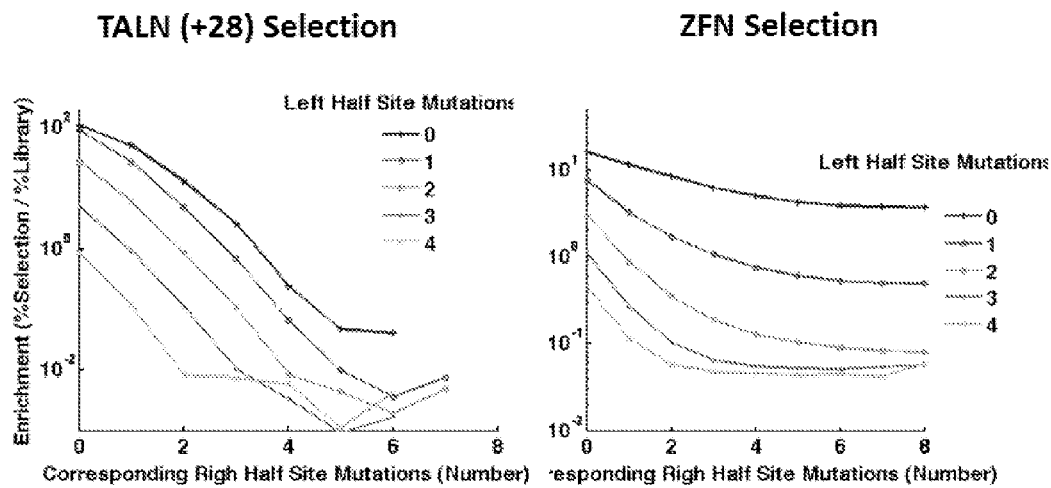

FIG. 49. Comparing TALNs vs. ZFNs. For the most part, in the TALN selection the enrichment is dependent on the total mutations in both half sites and not on the distribution of mutations between half sites like for zinc finger nucleases (ZFN). This observation combined with the context dependent binding of ZFNs potentially make ZFN far less specific than their TAL equivalents.

DEFINITIONS

As used herein and in the claims, the singular forms "a," "an," and "the" include the singular and the plural reference unless the context clearly indicates otherwise. Thus, for example, a reference to "an agent" includes a single agent and a plurality of such agents.

The term "concatemer," as used herein in the context of nucleic acid molecules, refers to a nucleic acid molecule that contains multiple copies of the same DNA sequences linked in a series. For example, a concatemer comprising ten copies of a specific sequence of nucleotides (e.g., $[XYZ]_{10}$), would comprise ten copies of the same specific sequence linked to each other in series, e.g., 5'-XYZXYZXYZXYZXYZXYZXYZXYZXYZXYZ-3'. A concatemer may comprise any number of copies of the repeat unit or sequence, e.g., at least 2 copies, at least 3 copies, at least 4 copies, at least 5 copies, at least 10 copies, at least 100 copies, at least 1000 copies, etc. An example of a concatemer of a nucleic acid sequence comprising a nuclease target site and a constant insert sequence would be [(target site)-(constant insert sequence)]$_{300}$. A concatemer may be a linear nucleic acid molecule, or may be circular.

The terms "conjugating," "conjugated," and "conjugation" refer to an association of two entities, for example, of two molecules such as two proteins, two domains (e.g., a binding domain and a cleavage domain), or a protein and an agent, e.g., a protein binding domain and a small molecule. The association can be, for example, via a direct or indirect (e.g., via a linker) covalent linkage or via non-covalent interactions. In some embodiments, the association is covalent. In some embodiments, two molecules are conjugated via a linker connecting both molecules. For example, in some embodiments where two proteins are conjugated to each other, e.g., a binding domain and a cleavage domain of an engineered nuclease, to form a protein fusion, the two proteins may be conjugated via a polypeptide linker, e.g., an amino acid sequence connecting the C-terminus of one protein to the N-terminus of the other protein.

The term "consensus sequence," as used herein in the context of nucleic acid sequences, refers to a calculated sequence representing the most frequent nucleotide residues found at each position in a plurality of similar sequences. Typically, a consensus sequence is determined by sequence alignment in which similar sequences are compared to each other and similar sequence motifs are calculated. In the context of nuclease target site sequences, a consensus sequence of a nuclease target site may, in some embodiments, be the sequence most frequently bound, or bound with the highest affinity, by a given nuclease.

The term "effective amount," as used herein, refers to an amount of a biologically active agent that is sufficient to elicit a desired biological response. For example, in some embodiments, an effective amount of a nuclease may refer to the amount of the nuclease that is sufficient to induce cleavage of a target site specifically bound and cleaved by the nuclease. As will be appreciated by the skilled artisan, the effective amount of an agent, e.g., a nuclease, a hybrid protein, or a polynucleotide, may vary depending on various factors as, for example, on the desired biological response, the specific allele, genome, target site, cell, or tissue being targeted, and the agent being used.

The term "enediyne," as used herein, refers to a class of bacterial natural products characterized by either nine- and ten-membered rings containing two triple bonds separated by a double bond (see, e.g., K. C. Nicolaou; A. L. Smith; E. W. Yue (1993). "Chemistry and biology of natural and designed enediynes". PNAS 90 (13): 5881-5888; the entire contents of which are incorporated herein by reference). Some enediynes are capable of undergoing Bergman cyclization, and the resulting diradical, a 1,4-dehydrobenzene derivative, is capable of abstracting hydrogen atoms from the sugar backbone of DNA which results in DNA strand cleavage (see, e.g., S. Walker; R. Landovitz; W. D. Ding; G. A. Ellestad; D. Kahne (1992). "Cleavage behavior of calicheamicin gamma 1 and calicheamicin T". Proc Natl Acad Sci U.S.A. 89 (10): 4608-12; the entire contents of which are incorporated herein by reference). Their reactivity with DNA confers an antibiotic character to many enediynes, and some enediynes are clinically investigated as anticancer antibiotics. Nonlimiting examples of enediynes are dynemicin, neocarzinostatin, calicheamicin, esperamicin (see, e.g., Adrian L. Smith and K. C. Bicolaou, "The Enediyne Antibiotics" J. Med. Chem., 1996, 39 (11), pp 2103-2117; and Donald Borders, "Enediyne antibiotics as antitumor agents," Informa Healthcare; $1^{st}$ edition (Nov. 23, 1994, ISBN-10: 0824789385; the entire contents of which are incorporated herein by reference).

The term "homing endonuclease," as used herein, refers to a type of restriction enzymes typically encoded by introns or inteins Edgell D R (February 2009). "Selfish DNA: homing endonucleases find a home". Curr Biol 19 (3): R115-R117; Jasin M (June 1996). "Genetic manipulation of genomonth with rare-cutting endonucleases". Trends Genet 12 (6): 224-8; Burt A, Koufopanou V (December 2004). "Homing endonuclease genes: the rise and fall and rise again of a selfish element". Curr Opin Genet Dev 14 (6): 609-15; the entire contents of which are incorporated herein by reference. Homing endonuclease recognition sequences are long enough to occur randomly only with a very low probability (approximately once every $7 \times 10^{10}$ bp), and are normally found in only one instance per genome.

The term "library," as used herein in the context of nucleic acids or proteins, refers to a population of two or more different nucleic acids or proteins, respectively. For example, a library of nuclease target sites comprises at least two nucleic acid molecules comprising different nuclease target sites. In some embodiments, a library comprises at least $10^1$, at least $10^2$, at least $10^3$, at least $10^4$, at least $10^5$, at least $10^6$, at least $10^7$, at least $10^8$, at least $10^9$, at least $10^{10}$, at least $10^{11}$, at least $10^{12}$, at least $10^{13}$, at least $10^{14}$, or at least $10^{15}$ different nucleic acids or proteins. In some embodiments, the members of the library may comprise randomized sequences, for example, fully or partially randomized sequences. In some embodiments, the library comprises nucleic acid molecules that are unrelated to each other, e.g., nucleic acids comprising fully randomized sequences. In other embodiments, at least some members of the library may be related, for example, they may be variants or derivatives of a particular sequence, such as a consensus target site sequence.

The term "linker," as used herein, refers to a chemical group or a molecule linking two adjacent molecules or moieties, e.g., a binding domain and a cleavage domain of a nuclease. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety.

The term "nuclease," as used herein, refers to an agent, for example a protein or a small molecule, capable of cleaving a phosphodiester bond connecting nucleotide residues in a nucleic acid molecule. In some embodiments, a nuclease is a protein, e.g., an enzyme that can bind a nucleic acid molecule and cleave a phosphodiester bond connecting nucleotide residues within the nucleic acid molecule. A nuclease may be an endonuclease, cleaving a phosphodiester bonds within a polynucleotide chain, or an exonuclease, cleaving a phosphodiester bond at the end of the polynucleotide chain. In some embodiments, a nuclease is a site-specific nuclease, binding and/or cleaving a specific phosphodiester bond within a specific nucleotide sequence, which is also referred to herein as the "recognition sequence," the "nuclease target site," or the "target site." In some embodiments, a nuclease recognizes a single stranded target site, while in other embodiments, a nuclease recognizes a double-stranded target site, for example a double-stranded DNA target site. The target sites of many naturally occurring nucleases, for example, many naturally occurring DNA restriction nucleases, are well known to those of skill in the art. In many cases, a DNA nuclease, such as EcoRI, HindIII, or BamHI, recognize a palindromic, double-stranded DNA target site of 4 to 10 base pairs in length, and cut each of the two DNA strands at a specific position within the target site. Some endonucleases cut a double-stranded nucleic acid target site symmetrically, i.e., cutting both strands at the same position so that the ends comprise base-paired nucleotides, also referred to herein as blunt ends. Other endonucleases cups a double-stranded nucleic acid target sites asymmetrically, i.e., cutting each strand at a different position so that the ends comprise unpaired nucleotides. Unpaired nucleotides at the end of a double-stranded DNA molecule are also referred to as "overhangs," e.g., as "5'-overhang" or as "3'-overhang," depending on whether the unpaired nucleotide(s) form(s) the 5' or the 5' end of the respective DNA strand. Double-stranded DNA molecule ends ending with unpaired nucleotide(s) are also referred to as sticky ends, as they can "stick to" other double-stranded DNA molecule ends comprising complementary unpaired nucleotide(s). A nuclease protein typically comprises a "binding domain" that mediates the interaction of the protein with the nucleic acid substrate, and also, in some cases, specifically binds to a target site, and a "cleavage domain" that catalyzes the cleavage of the phosphodiester bond within the nucleic acid backbone. In some embodiments a nuclease protein can bind and cleave a nucleic acid molecule in a monomeric form, while, in other embodiments, a nuclease protein has to dimerize or multimerize in order to cleave a target nucleic acid molecule. Binding domains and cleavage domains of naturally occurring nucleases, as well as modular binding domains and cleavage domains that can be fused to create nucleases binding specific target sites, are well known to those of skill in the art. For example, zinc fingers or transcriptional activator like elements can be used as binding domains to specifically bind a desired target site, and fused or conjugated to a cleavage domain, for example, the cleavage domain of FokI, to create an engineered nuclease cleaving the target site.

The terms "nucleic acid" and "nucleic acid molecule," as used herein, refers to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, i.e. analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications' A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "pharmaceutical composition," as used herein, refers to a composition that can be administrated to a subject in the context of treatment of a disease or disorder. In some embodiments, a pharmaceutical composition comprises an active ingredient, e.g. a nuclease or a nucleic acid encoding a nuclease, and a pharmaceutically acceptable excipient.

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to as cancer.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. A protein may comprise different domains, for example, a nucleic acid binding domain and a nucleic acid cleavage domain. In some embodiments, a protein comprises a proteinaceous part, e.g., an amino acid sequence constituting a nucleic acid binding domain, and an organic compound, e.g., a compound that can act as a nucleic acid cleavage agent.

The term "randomized," as used herein in the context of nucleic acid sequences, refers to a sequence or residue within a sequence that has been synthesized to incorporate a mixture of free nucleotides, for example, a mixture of all four nucleotides A, T, G, and C. Randomized residues are typically represented by the letter N within a nucleotide sequence. In some embodiments, a randomized sequence or residue is fully randomized, in which case the randomized residues are synthesized by adding equal amounts of the nucleotides to be incorporated (e.g., 25% T, 25% A, 25% G, and 25% C) during the synthesis step of the respective sequence residue. In some embodiments, a randomized sequence or residue is partially randomized, in which case the randomized residues are synthesized by adding non-equal amounts of the nucleotides to be incorporated (e.g., 79% T, 7% A, 7% G, and 7% C) during the synthesis step of the respective sequence residue. Partial randomization allows for the generation of sequences that are templated on a given sequence, but have incorporated mutations at a desired frequency. E.g., if a known nuclease target site is used as a synthesis template, partial randomization in which at each step the nucleotide represented at the respective residue is added to the synthesis at 79%, and the other three nucleotides are added at 7% each, will result in a mixture of partially randomized target sites being synthesized, which still represent the consensus sequence of the original target site, but which differ from the original target site at each residue with a statistical frequency of 21% for each residue so synthesized (distributed binomially). In some embodiments, a partially randomized sequence differs from the consensus sequence by more than 5%, more than 10%, more than 15%, more than 20%, more than 25%, or more than 30% on average, distributed binomially. In some embodiments, a partially randomized sequence differs from the consensus site by no more than 10%, no more than 15%, no more than 20%, no more than 25%, nor more than 30%, no more than 40%, or no more than 50% on average, distributed binomially.

The terms "small molecule" and "organic compound" are used interchangeably herein and refer to molecules, whether naturally-occurring or artificially created (e.g., via chemical synthesis) that have a relatively low molecular weight. Typically, an organic compound contains carbon. An organic compound may contain multiple carbon-carbon bonds, stereocenters, and other functional groups (e.g., amines, hydroxyl, carbonyls, or heterocyclic rings). In some embodiments, organic compounds are monomeric and have a molecular weight of less than about 1500 g/mol. In certain embodiments, the molecular weight of the small molecule is less than about 1000 g/mol or less than about 500 g/mol. In certain embodiments, the small molecule is a drug, for example, a drug that has already been deemed safe and effective for use in humans or animals by the appropriate governmental agency or regulatory body. In certain embodiments, the organic molecule is known to bind and/or cleave a nucleic acid. In some embodiments, the organic compound is an enediyne. In some embodiments, the organic compound is an antibiotic drug, for example, an anticancer antibiotic such as dynemicin, neocarzinostatin, calicheamicin, esperamicin, bleomycin, or a derivative thereof.

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode.

The terms "target nucleic acid," and "target genome," as used herein in the context of nucleases, refer to a nucleic acid molecule or a genome, respectively, that comprises at least one target site of a given nuclease.

The term "target site," used herein interchangeably with the term "nuclease target site," refers to a sequence within a nucleic acid molecule that is hound and cleaved by a nuclease. A target site may be single-stranded or double-stranded. In the context of nucleases that dimerize, for example, nucleases comprising a FokI DNA cleavage domain, a target sites typically comprises a left-half site (bound by one monomer of the nuclease), a right-half site (bound by the second monomer of the nuclease), and a spacer sequence between the half sites in which the cut is made. This structure ([left-half site]-[spacer sequence]-[right-half site]) is referred to herein as an LSR structure. In some embodiments, the left-half site and/or the right-half site is between 10-18 nucleotides long. In some embodiments, either or both half-sites are shorter or longer. In some embodiments, the left and right half sites comprise different nucleic acid sequences.

The term "Transcriptional Activator-Like Effector," (TALE) as used herein, refers to bacterial proteins comprising a DNA binding domain, which contains a highly conserved 33-34 amino acid sequence comprising a highly variable two-amino acid motif (Repeat Variable Diresidue, RVD). The RVD motif determines binding specificity to a nucleic acid sequence, and can be engineered according to methods well known to those of skill in the art to specifically bind a desired DNA sequence (see, e.g., Miller, Jeffrey; et. al. (February 2011). "A TALE nuclease architecture for efficient genome editing". *Nature Biotechnology* 29 (2): 143-8; Zhang, Feng; et. al. (February 2011). "Efficient construction of sequence-specific TAL effectors for modulating mammalian transcription". *Nature Biotechnology* 29 (2): 149-53; Geißler, R.; Scholze, H.; Hahn, S.; Streubel, J.; Bonas, U.; Behrens, S. E.; Boch, J. (2011), Shiu, Shin-Han. ed. "Transcriptional Activators of Human Genes with Programmable DNA-Specificity". *PLoS ONE* 6 (5): e19509; Boch, Jens (February 2011). "TALEs of genome targeting". *Nature Biotechnology* 29 (2): 135-6; Boch, Jens; et. al. (December 2009). "Breaking the Code of DNA Binding Specificity of TAL-Type III Effectors". *Science* 326 (5959): 1509-12; and Moscou, Matthew J.; Adam J. Bogdanove (December 2009). "A Simple Cipher Governs DNA Recognition by TAL Effectors". *Science* 326 (5959): 1501; the entire contents of each of which are incorporated herein by reference). The simple relationship between amino acid sequence and DNA recognition has allowed for the engineering of specific DNA binding domains by selecting a combination of repeat segments containing the appropriate RVDs.

The term "Transcriptional Activator-Like Element Nuclease," (TALEN) as used herein, refers to an artificial nuclease comprising a transcriptional activator like effector DNA binding domain to a DNA cleavage domain, for example, a FokI domain. A number of modular assembly schemes for generating engineered TALE constructs have been reported (Zhang, Feng; et. al. (February 2011). "Efficient construction of sequence-specific TAL effectors for modulating mammalian transcription". *Nature Biotechnology* 29 (2): 149-53; Geißler, R.; Scholze, H.; Hahn, S.; Streubel, J.; Bonas, U.; Behrens, S. E.; Boch, J. (2011), Shiu, Shin-Han. ed. "Transcriptional Activators of Human Genes with Programmable DNA-Specificity". *PLoS ONE* 6 (5): e19509; Cermak, T.; Doyle, E. L.; Christian, M.; Wang, L.; Zhang, Y.; Schmidt, C.; Bailer, J. A.; Somia, N. V. et al. (2011). "Efficient design and assembly of custom TALEN and other TAL effector-based constructs for DNA targeting". *Nucleic Acids Research*; Morbitzer, R.; Elsaesser, J.; Hausner, J.; Lahaye, T. (2011). "Assembly of custom TALE-type DNA binding domains by modular cloning". *Nucleic Acids Research*; Li, T.; Huang, S.; Zhao, X.; Wright, D. A.; Carpenter, S.; Spalding, M. H.; Weeks, D. P.; Yang, B. (2011). "Modularly assembled designer TAL effector nucleases for targeted gene knockout and gene replacement in eukaryotes". *Nucleic Acids Research*; Weber, E.; Gruetzner, R.; Werner, S.; Engler, C.; Marillonnet, S. (2011). Bendahmane, Mohammed. ed. "Assembly of Designer TAL Effectors by Golden Gate Cloning". *PLoS ONE* 6 (5): e19722; the entire contents of each of which are incorporated herein by reference).

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example to prevent or delay their recurrence.

The term "zinc finger," as used herein, refers to a small nucleic acid-binding protein structural motif characterized by a fold and the coordination of one or more zinc ions that stabilize the fold. Zinc fingers encompass a wide variety of differing protein structures (see, e.g., Klug A, Rhodes D (1987). "Zinc fingers: a novel protein fold for nucleic acid recognition". Cold Spring Harb. Symp. Quant. Biol. 52: 473-82, the entire contents of which are incorporated herein by reference). Zinc fingers can be designed to bind a specific sequence of nucleotides, and zinc finger arrays comprising fusions of a series of zinc fingers, can be designed to bind virtually any desired target sequence. Such zinc finger arrays can form a binding domain of a protein, for example, of a nuclease, e.g., if conjugated to a nucleic acid cleavage domain. Different type of zinc finger motifs are known to those of skill in the art, including, but not limited to, $Cys_2His_2$, Gag knuckle, Treble clef, Zinc ribbon, $Zn_2/Cys_6$, and TAZ2 domain-like motifs (see, e.g., Krishna S S, Majumdar I, Grishin N V (January 2003). "Structural classification of zinc fingers: survey and summary". *Nucleic Acids Res.* 31 (2): 532-50). Typically, a single zinc finger motif binds 3 or 4 nucleotides of a nucleic acid molecule. Accordingly, a zinc finger domain comprising 2 zinc finger motifs may bind 6-8 nucleotides, a zinc finger domain comprising 3 zinc finger motifs may bind 9-12 nucleotides, a zinc finger domain comprising 4 zinc finger motifs may bind 12-16 nucleotides, and so forth. Any suitable protein engineering technique can be employed to alter the DNA-binding specificity of zinc fingers and/or design novel zinc finger fusions to bind virtually any desired target sequence from 3-30 nucleotides in length (see, e.g., Pabo C O, Peisach E, Grant R A (2001). "Design and selection of novel cys2His2 Zinc finger proteins". *Annual Review of Biochemistry* 70: 313-340; Jamieson A C, Miller J C, Pabo C O (2003). "Drug discovery with engineered zinc-finger proteins". *Nature Reviews Drug Discovery* 2 (5): 361-368; and Liu Q, Segal D J, Ghiara J B, Barbas C F (May 1997). "Design of polydactyl zinc-finger proteins for unique addressing within complex genomes". *Proc. Natl. Acad. Sci. U.S.A.* 94 (11); the entire contents of each of which are incorporated herein by reference). Fusions between engineered zinc finger arrays and protein domains that cleave a nucleic acid can be used to generate a "zinc finger nuclease." A zinc finger nuclease typically comprises a zinc finger domain that binds a specific target site within a nucleic acid molecule, and a nucleic acid cleavage domain that cuts the nucleic acid molecule within or in proximity to the target site bound by the binding domain. Typical engineered zinc finger nucleases comprise a binding domain having between 3 and 6 individual zinc finger motifs and binding target sites ranging from 9 base pairs to 18 base pairs in length. Longer target sites are particularly attractive in situations where it is desired to bind and cleave a target site that is unique in a given genome.

The term "zinc finger nuclease," as used herein, refers to a nuclease comprising a nucleic acid cleavage domain conjugated to a binding domain that comprises a zinc finger array. In some embodiments, the cleavage domain is the cleavage domain of the type II restriction endonuclease FokI. Zinc finger nucleases can be designed to target virtually any desired sequence in a given nucleic acid molecule for cleavage, and the possibility to the design zinc finger binding domains to bind unique sites in the context of complex genomes allows for targeted cleavage of a single genomic site in living cells, for example, to achieve a targeted genomic alteration of therapeutic value. Targeting a double-strand break to a desired genomic locus can be used to introduce frame-shift mutations into the coding sequence of a gene due to the error-prone nature of the non-homologous DNA repair pathway. Zinc finger nucleases can be generated to target a site of interest by methods well known to those of skill in the art. For example, zinc finger binding domains with a desired specificity can be designed by combining individual zinc finger motifs of known specificity. The structure of the zinc finger protein Zif268 bound to DNA has informed much of the work in this field and the concept of obtaining zinc fingers for each of the 64 possible base pair triplets and then mixing and matching these modular zinc fingers to design proteins with any desired sequence specificity has been described (Pavletich N P, Pabo C O (May 1991). "Zinc finger-DNA recognition: crystal structure of a Zif268-DNA complex at 2.1 Å". *Science* 252 (5007): 809-17, the entire contents of which are incorporated herein). In some embodiments, separate zinc fingers that each recognize a 3 base pair DNA sequence are combined to generate 3-, 4-, 5-, or 6-finger arrays that recognize target sites ranging from 9 base pairs to 18 base pairs in length. In some embodiments, longer arrays are contemplated. In other embodiments, 2-finger modules recognizing 6-8 nucleotides are combined to generate 4-, 6-, or 8-zinc finger arrays. In some embodiments, bacterial or phage display is employed to develop a zinc finger domain that recognizes a desired nucleic acid sequence, for example, a desired nuclease target site of 3-30 bp in length. Zinc finger nucleases, in some embodiments, comprise a zinc finger binding domain and a cleavage domain fused or otherwise conjugated to each other via a linker, for example, a polypeptide linker. The length of the linker determines the distance of the cut from the nucleic acid sequence bound by the zinc finger domain. If a shorter linker is used, the cleavage domain will cut the nucleic acid closer to the bound nucleic acid sequence, while a longer linker will result in a greater distance between the cut and the bound nucleic acid sequence. In some embodiments, the cleavage domain of a zinc finger nuclease has to dimerize in order to cut a bound nucleic acid. In some such embodiments, the dimer is a heterodimer of two monomers, each of which comprise a different zinc finger binding domain. For example, in some embodiments, the dimer may comprise one monomer comprising zinc finger domain A conjugated to a FokI cleavage domain, and one monomer comprising zinc finger domain B conjugated to a FokI cleavage domain. In this nonlimiting example, zinc finger domain A binds a nucleic acid sequence on one side of the target site, zinc finger domain B binds a nucleic acid sequence on the other side of the target site, and the dimerize FokI domain cuts the nucleic acid in between the zinc finger domain binding sites.

DETAILED DESCRIPTION OF CERTAIN EMBODIMENTS OF THE INVENTION

Introduction

Site-specific nucleases are powerful tools for the targeted modification of a genome. Some site specific nucleases can theoretically achieve a level of specificity for a target cleavage site that would allow to target a single unique site in a genome for cleavage without affecting any other genomic site. It has been reported that nuclease cleavage in living cells triggers a DNA repair mechanism that frequently results in a modification of the cleaved, repaired genomic sequence, for example, via homologous recombination. Accordingly, the targeted cleavage of a specific unique sequence within a genome opens up new avenues for gene targeting and gene modification in living cells, including cells that are hard to manipulate with conventional gene targeting methods, such as many human somatic or embryonic stem cells. Nuclease-mediated modification of disease-related sequences, e.g., the CCR-5 allele in HIV/AIDS patients, or of genes necessary for tumor neovascularization, can be used in the clinical context, and two site specific nucleases are currently in clinical trials.

One important aspect in the field of site-specific nuclease-mediated modification are off-target nuclease effects, e.g., the cleavage of genomic sequences that differ from the intended target sequence by one or more nucleotides. Undesired side effects of off-target cleavage ranges from insertion into unwanted loci during a gene targeting event to severe complications in a clinical scenario. Off target cleavage of sequences encoding essential gene functions or tumor suppressor genes by an endonuclease administered to a subject may result in disease or even death of the subject. Accordingly, it is desirable to characterize the cleavage preferences of a nuclease before using it in the laboratory or the clinic in order to determine its efficacy and safety. Further, the characterization of nuclease cleavager properties allows for the selection of the nuclease best suited for a specific task from a group of candidate nucleases, or for the selection of evolution products obtained from existing nucleases. Such a characterization of nuclease cleavage properties may also inform the de-novo design of nucleases with enhanced properties, such as enhanced specificity or efficiency.

In many scenarios where a nuclease is employed for the targeted manipulation of a nucleic acid, cleavage specificity is a crucial feature. The imperfect specificity of some engineered nuclease binding domains can lead to off-target cleavage and undesired effects both in vitro and in vivo. Current methods of evaluating site-specific nuclease specificity, including ELISA assays, microarrays, one-hybrid systems, SELEX and its variants, and Rosetta-based computational predictions, are all premised on the assumption that the binding specificity of nuclease molecules is equivalent or proportionate to their cleavage specificity.

However, the work presented here is based on the discovery that prediction of nuclease off-target binding effects constitutes an imperfect approximation of a nuclease's off-target cleavage effects that may result in undesired biological effects. This finding is consistent with the notion that the reported toxicity of some site specific DNA nucleases results from off-target DNA cleavage, rather than off-target binding alone.

The methods and reagents provided herein allow for an accurate evaluation of a given nuclease's target site specificity and provide strategies for the selection of suitable unique target sites and the design of highly specific nucleases for the targeted cleavage of a single site in the context of a complex genome. Further, methods, reagents, and strategies provided herein allow those of skill to enhance the specificity and minimize the off-target effects of any given site-specific nuclease. While of particular relevance to DNA and DNA-cleaving nucleases, the inventive concepts, methods, strategies, and reagents provided herein are not limited in this respect, but can be applied to any nucleic acid: nuclease pair.

Identifying Nuclease Target Sites Cleaved by a Site-Specific Nuclease

Some aspects of this invention provide methods and reagents to determine the nucleic acid target sites cleaved by any site-specific nuclease. In general, such methods comprise contacting a given nuclease with a library of target sites under conditions suitable for the nuclease to bind and cut a target site, and determining which target sites the nuclease actually cuts. A determination of a nuclease's target site profile based on actual cutting has the advantage over methods that rely on binding that it measures a parameter more relevant for mediating undesired off-target effects of site-specific nucleases.

In some embodiments, a method for identifying a target site of a nuclease is provided. In some embodiments, the method comprises (a) providing a nuclease that cuts a double-stranded nucleic acid target site and creates a 5' overhang, wherein the target site comprises a [left-half site]-[spacer sequence]-[right-half site] (LSR) structure, and the nuclease cuts the target site within the spacer sequence. In some embodiments, the method comprises (b) contacting the nuclease with a library of candidate nucleic acid molecules, wherein each nucleic acid molecule comprises a concatemer of a sequence comprising a candidate nuclease target site and a constant insert sequence, under conditions suitable for the nuclease to cut a candidate nucleic acid molecule comprising a target site of the nuclease. In some embodiments, the method comprises (c) filling in the 5' overhangs of a nucleic acid molecule that has been cut twice by the nuclease and comprises a constant insert sequence flanked by a left half-site and cut spacer sequence on one side, and a right half-site and cut spacer sequence on the other side, thereby creating blunt ends. In some embodiments, the method comprises (d) identifying the nuclease target site cut by the nuclease by determining the sequence of the left-half site, the right-half-site, and/or the spacer sequence of the nucleic acid molecule of step (c). In some embodiments, the method comprises providing a nuclease and contacting the nuclease with a library of candidate nucleic acid molecules comprising candidate target sites. In some embodiments, the candidate nucleic acid molecules are double-stranded nucleic acid molecules. In some embodiments, the candidate nucleic acid molecules are DNA molecules. In some embodiments, the nuclease dimerizes at the target site, and the target site comprises an LSR structure ([left-half site]-[spacer sequence]-[right-half site]). In some embodiments, the nuclease cuts the target site within the spacer sequence. In some embodiments, the nuclease is a nuclease that cuts a double-stranded nucleic acid target site and creates a 5' overhang. In some embodiments, each nucleic acid molecule in the library comprises a concatemer of a sequence comprising a candidate nuclease target site and a constant insert sequence.

For example, in some embodiments, the candidate nucleic acid molecules of the library comprise the structure $R_1$-[(LSR)-(constant region)]$_x$-$R_2$, wherein R1 and R2 are, independently, nucleic acid sequences that may comprise a fragment of the [(LSR)-(constant region)] repeat unit, and X is an integer between 2 and y. In some embodiments, y is at least $10^1$, at least $10^2$, at least $10^3$, at least $10^4$, at least $10^5$, at least $10^6$, at least $10^7$, at least $10^8$, at least $10^9$, at least $10^{10}$, at least $10^{11}$, at least $10^{12}$, at least $10^{13}$, at least $10^{14}$, or at least $10^{15}$. In some embodiments, y is less than $10^2$, less than $10^3$, less than $10^4$, less than $10^5$, less than $10^6$, less than $10^7$, less than $10^8$, less than $10^9$, less than $10^{10}$, less than $10^{11}$, less than $10^{12}$, less than $10^{13}$, less than $10^{14}$, or less than $10^{15}$. The constant region, in some embodiments, is of a length that allows for efficient self ligation of a single repeat unit. Suitable lengths will be apparent to those of skill in the art. For example, in some embodiments, the constant region is between 100 and 1000 base pairs long, for example, about 100 base pairs, about 200 base pairs, about 300 base pairs, about 400 base pairs, about 450 base pairs, about 500 base pairs, about 600 base pairs, about 700 base pairs, about 800 base pairs, about 900 base pairs, or about 1000 base pairs long in some embodiments, the constant region is shorter than about 100 base pairs or longer than about 1000 base pairs.

Incubation of the nuclease with the library nucleic acids will result in cleavage of those concatemers in the library that comprise target sites that can be bound and cleaved by the nuclease. If a given nuclease cleaves a specific target site with high efficiency, a concatemer comprising target sites will be cut multiple times, resulting in the generation of fragments comprising a single repeat unit. The repeat unit released from the concatemer by nuclease cleavage will be of the structure $S_2R$-(constant region)-$LS_1$, wherein $S_1$ and $S_2$ represent complementary spacer region fragments after being cut by the nuclease. Any repeat units released from library candidate molecules can then be isolated and/or the sequence of the LSR cleaved by the nuclease identified by sequencing the $S_2R$ and $LS_1$ regions of released repeat units.

Any method suitable for isolation and sequencing of the repeat units can be employed to elucidate the LSR sequence cleaved by the nuclease. For example, since the length of the constant region is known, individual released repeat units can be separated based on their size from the larger uncut library nucleic acid molecules as well as from fragments of library nucleic acid molecules that comprise multiple repeat units (indicating non-efficient targeted cleavage by the nuclease). Suitable methods for separating and/or isolating nucleic acid molecules based on their size a well-known to those of skill in the art and include, for example, size fractionation methods, such as gel electrophoresis, density gradient centrifugation, and dialysis over a semi-permeable membrane with a suitable molecular cutoff value. The separated/isolated nucleic acid molecules can then be further characterized, for example, by ligating PCR and/or sequencing adapters to the cut ends and amplifying and/or sequencing the respective nucleic acids. Further, if the length of the constant region is selected to favor self-ligation of individual released repeat units, such individual released repeat units may be enriched by contacting the nuclease treated library molecules with a ligase and subsequent amplification and/or sequencing based on the circularized nature of the self-ligated individual repeat units.

In some embodiments, where a nuclease is used that generates 5' overhangs as a result of cutting a target nucleic acid, the 5' overhangs of the cut nucleic acid molecules are filled in. Methods for filling in 5' overhangs are well known to those of skill in the art and include, for example, methods using DNA polymerase I Klenow fragment lacking exonuclease activity (Klenow (3'→5' exo-)). Filling in 5' overhangs results in the overhang-templated extension of the recessed strand, which, in turn, results in blunt ends. In the case of single repeat units released from library concatemers, the resulting structure is a blunt-ended $S_2'R$-(constant region)-$LS_1'$, with $S_1'$ and $S_2'$ comprising blunt ends. PCR and/or sequencing adapters can then be added to the ends by blunt end ligation and the respective repeat units (including $S_2'R$ and $LS_1'$ regions) can be sequenced. From the sequence data, the original LSR region can be deducted. Blunting of the overhangs created during the nuclease cleavage process also allows for distinguishing between target sites that were properly cut by the respective nuclease and target sites that were non-specifically cut e.g., based on non-nuclease effects such as physical shearing. Correctly cleaved nuclease target sites can be recognized by the existence of complementary $S_2'R$ and $LS_1'$ regions, which comprise a duplication of the overhang nucleotides as a result of the overhang fill in, while target sites that were not cleaved by the respective nuclease are unlikely to comprise overhang nucleotide duplications. In some embodiments, the method comprises identifying the nuclease target site cut by the nuclease by determining the sequence of the left-half site, the right-half-site, and/or the spacer sequence of a released individual repeat unit. Any suitable method for amplifying and/or sequencing can be used to identify the LSR sequence of the target site cleaved by the respective nuclease. Methods for amplifying and/or sequencing nucleic acid molecules are well known to those of skill in the art and the invention is not limited in this respect.

Some of the methods and strategies provided herein allow for the simultaneous assessment of a plurality of candidate target sites as possible cleavage targets for any given nuclease. Accordingly, the data obtained from such methods can be used to compile a list of target sites cleaved by a given nuclease, which is also referred to herein as a target site profile. If they sequencing method is used that allows for the generation of quantitative sequencing data, it is also possible to record the relative abundance of any nuclease target site detected to be cleaved by the respective nuclease. Target sites that are cleaved more efficiently by the nuclease will be detected more frequently in the sequencing step, while target sites that are not cleaved efficiently will only rarely release an individual repeat unit from a candidate concatemer, and thus, will only generate few, if any sequencing reads. Such quantitative sequencing data can be integrated into a target site profile to generate a ranked list of highly preferred and less preferred nuclease target sites.

The methods and strategies of nuclease target site profiling provided herein can be applied to any site-specific nuclease, including, for example, ZFNs, TALENs, and homing endonucleases. As described in more detail herein, nuclease specificity typically decreases with increasing nuclease concentration, and the methods described herein can be used to determine a concentration at which a given nuclease efficiently cuts its intended target site, but does not efficiently cut any off target sequences. In some embodiments, a maximum concentration of a therapeutic nuclease is determined at which the therapeutic nuclease cuts its intended nuclease target site, but does not cut more than 10, more than 5, more than 4, more than 3, more than 2, more than 1, or any additional nuclease target sites. In some embodiments, a therapeutic nuclease is administered to a subject in an amount effective to generate a final concentration equal or lower to the maximum concentration determined as described above.

Nuclease Target Site Libraries

Some embodiments of this invention provide libraries of nucleic acid molecules for nuclease target site profiling. In some embodiments such a library comprises a plurality of nucleic acid molecules, each comprising a concatemer of a candidate nuclease target site and a constant insert sequence spacer sequence. For example, in some embodiments, the candidate nucleic acid molecules of the library comprise the structure $R_1$-[(LSR)-(constant region)]$_X$-$R_2$, wherein R1 and R2 are, independently, nucleic acid sequences that may comprise a fragment of the [(LSR)-(constant region)] repeat unit, and X is an integer between 2 and y. In some embodiments, y is at least $10^1$, at least $10^2$, at least $10^3$, at least $10^4$, at least $10^5$, at least $10^6$, at least $10^7$, at least $10^8$, at least $10^9$, at least $10^{10}$, at least $10^{11}$, at least $10^{12}$, at least $10^{13}$, at least $10^{14}$, or at least $10^{15}$. In some embodiments, y is less than $10^2$, less than $10^3$, less than $10^4$, less than $10^5$, less than $10^6$, less than $10^7$, less than $10^8$, less than $10^9$, less than $10^{10}$, less than $10^{11}$, less than $10^{12}$, less than $10^{13}$, less than $10^{14}$, or less than $10^{15}$. The constant region, in some embodiments, is of a length that allows for efficient self ligation of a single repeat unit. In some embodiments, the constant region is of a length that allows for efficient separation of single repeat units from fragments comprising two or more repeat units. In some embodiments, the concentration is over length allows for efficient sequencing of a complete repeat unit in one sequencing read. Suitable lengths will be apparent to those of skill in the art. For example, in some embodiments, the constant region is between 100 and 1000 base pairs long, for example, about 100 base pairs, about 200 base pairs, about 300 base pairs, about 400 base pairs, about 450 base pairs, about 500 base pairs, about 600 base pairs, about 700 base pairs, about 800 base pairs, about 900 base pairs, or about 1000 base pairs long in some embodiments, the constant region is shorter than about 100 base pairs or longer than about 1000 base pairs.

An LSR site typically comprises a [left-half site]-[spacer sequence]-[right-half site] structure. The lengths of the half-size and the spacer sequence will depend on the specific nuclease to be evaluated. In general, the half-sites will be 6-30 nucleotides long, and preferably 10-18 nucleotides long. For example, each half site individually may be 6, 7, 8, 9, 10, 11, 12, 13, 14, 15, 16, 17, 18, 19, 20, 21, 22, 23, 24, 25, 26, 27, 28, 29, or 30 nucleotides long. In some embodiments, an LSR site may be longer than 30 nucleotides. In some embodiments, the left half site and the right half site of an LSR are of the same length. In some embodiments, the left half site and the right half site of an LSR are of different lengths. In some embodiments, the left half site and the right half site of an LSR are of different sequences. In some embodiments, a library is provided that comprises candidate nucleic acids which comprise LSRs that can be cleaved by a FokI cleavage domain, a Zinc Finger Nuclease (ZFN), a Transcription Activator-Like Effector Nuclease (TALEN), a homing endonuclease, an organic compound nuclease, an enediyne, an antibiotic nuclease, dynemicin, neocarzinostatin, calicheamicin, esperamicin, and/or bleomycin.

In some embodiments, a library of candidate nucleic acid molecules is provided that comprises at least $10^5$, at least $10^6$, at least $10^7$, at least $10^8$, at least $10^9$, at least $10^{10}$, at least $10^{11}$, or at least $10^{12}$ different candidate nuclease target sites. In some embodiments, the candidate nucleic acid molecules of the library are concatemers produced from a secularized templates by rolling cycle amplification. In some embodiments, the library comprises nucleic acid molecules, e.g., concatemers, of a molecular weight of at least 5 kDa, at least 6 kDa, at least 7 kDa, at least 8 kDa, at least 9 kDa, at least 10 kDa, at least 12 kDa, or at least 15 kDa. in some embodiments, the molecular weight of the nucleic acid molecules within the library may be larger than 15 kDa. In some embodiments, the library comprises nucleic acid molecules within a specific size range, for example, within a range of 5-7 kDa, 5-10 kDa, 8-12 kDa, 10-15 kDa, or 12-15 kDa, or 5-10 kDa or any possible subrange. While some methods suitable for generating nucleic acid concatemers according to some aspects of this invention result in the generation of nucleic acid molecules of greatly different molecular weights, such mixtures of nucleic acid molecules may be size fractionated to obtain a desired size distribution. Suitable methods for enriching nucleic acid molecules of a desired size or excluding nucleic acid molecules of a desired size are well known to those of skill in the art and the invention is not limited in this respect.

In some embodiments, a library is provided comprising candidate nucleic acid molecules that comprise target sites with a partially randomized left-half site, a partially randomized right-half site, and/or a partially randomized spacer sequence.

In some embodiments, the library is provided comprising candidate nucleic acid molecules that comprise target sites with a partially randomized left half site, a fully randomized spacer sequence, and a partially randomized right half site. In some embodiments, partially randomized sites differ from the consensus site by more than 5%, more than 10%, more than 15%, more than 20%, more than 25%, or more than 30% on average, distributed binomially. In some embodiments, partially randomized sites differ from the consensus site by no more than 10%, no more than 15%, no more than 20%, no more than 25%, nor more than 30%, no more than 40%, or no more than 50% on average, distributed binomially.

For example, in some embodiments partially randomized sites differ from the consensus site by more than 5%, but by no more than 10%; by more than 10%, but by no more than 20%; by more than 20%, but by no more than 25%; by more than 5%, but by no more than 20%, and so on. Using partially randomized nuclease target sites in the library is useful to increase the concentration of library members comprising target sites that are closely related to the consensus site, for example, that differ from the consensus sites in only one, only two, only three, only four, or only five residues. The rationale behind this is that a given nuclease, for example a given ZFN, is likely to cut its intended target site and any closely related target sites, but unlikely to cut a target sites that is vastly different from or completely unrelated to the intended target site. Accordingly, using a library comprising partially randomized target sites can be more efficient than using libraries comprising fully randomized target sites without compromising the sensitivity in detecting any off target cleavage events for any given nuclease. Thus, the use of partially randomized libraries significantly reduces the cost and effort required to produce a library having a high likelihood of covering virtually all off target sites of a given nuclease. In some embodiments however it may be desirable to use a fully randomized library of target sites, for example, in embodiments, where the specificity of a given nuclease is to be evaluated in the context of any possible site in a given genome.

Selection and Design of Site-Specific Nucleases

Some aspects of this invention provide methods and strategies for selecting and designing site-specific nucleases that allow the targeted cleavage of a single, unique sites in the context of a complex genome. In some embodiments, a method is provided that comprises providing a plurality of candidate nucleases that are designed or known to cut the same consensus sequence; profiling the target sites actually cleaved by each candidate nuclease, thus detecting any cleaved off-target sites (target sites that differ from the consensus target site); and selecting a candidate nuclease based on the off-target site(s) so identified. In some embodiments, this method is used to select the most specific nuclease from a group of candidate nucleases, for example, the nuclease that cleaves the consensus target site with the highest specificity, the nuclease that cleaves the lowest number of off-target sites, the nuclease that cleaves the lowest number of off-target sites in the context of a target genome, or a nuclease that does not cleave any target site other than the consensus target site. In some embodiments, this method is used to select a nuclease that does not cleave any off-target site in the context of the genome of a subject at concentration that is equal to or higher than a therapeutically effective concentration of the nuclease.

The methods and reagents provided herein can be used, for example, to evaluate a plurality of different nucleases targeting the same intended targets site, for example, a plurality of variations of a given site-specific nuclease, for example a given zinc finger nuclease. Accordingly, such methods may be used as the selection step in evolving or designing a novel site-specific nucleases with improved specificity.

Identifying Unique Nuclease Target Sites within a Genome

Some embodiments of this invention provide a method for selecting a nuclease target site within a genome. As described in more detail elsewhere herein, it was surprisingly discovered that off target sites cleaved by a given nuclease are typically highly similar to the consensus target site, e.g., differing from the consensus target site in only one, only two, only three, only four, or only five nucleotide residues. Based on this discovery, a nuclease target sites within the genome can be selected to increase the likelihood of a nuclease targeting this site not cleaving any off target sites within the genome. For example, in some embodiments, a method is provided that comprises identifying a candidate nuclease target site; and comparing the candidate nuclease target site to other sequences within the genome. Methods for comparing candidate nuclease target sites to other sequences within the genome are well known to those of skill in the art and include for example sequence alignment methods, for example, using a sequence alignment software or algorithm such as BLAST on a general purpose computer. A suitable unique nuclease target site can then be selected based on the results of the sequence comparison. In some embodiments, if the candidate nuclease target site differs from any other sequence within the genome by at least 3, at least 4, at least 5, at least 6, at least 7, at least 8, at least 9, or at least 10 nucleotides, the nuclease target site is selected as a unique site within the genome, whereas if the site does not fulfill this criteria, the site may be discarded. In some embodiments, once a site is selected based on the sequence comparison, as outlined above, a site-specific nuclease targeting the selected site is designed. For example, a zinc finger nuclease may be designed to target any selected nuclease target site by constructing a zinc finger array binding the target site, and conjugating the zinc finger array to a DNA cleavage domain. In embodiments where the DNA cleavage domain needs to dimerize in order to cleave DNA, to zinc finger arrays will be designed, each binding a half site of the nuclease target site, and each conjugated to a cleavage domain. In some embodiments, nuclease designing and/or generating is done by recombinant technology. Suitable recombinant technologies are well known to those of skill in the art, and the invention is not limited in this respect.

In some embodiments, a site-specific nuclease designed or generated according to aspects of this invention is isolated and/or purified. The methods and strategies for designing site-specific nucleases according to aspects of this invention can be applied to design or generate any site-specific nuclease, including, but not limited to Zinc Finger Nucleases, Transcription Activator-Like Effector Nucleases (TALENs), homing endonucleases, organic compound nucleases, enediyne nucleases, antibiotic nucleases, and dynemicin, neocarzinostatin, calicheamicin, esperamicin, bleomycin, or a derivative thereof variants or derivatives.

Site-Specific Nucleases

Some aspects of this invention provide isolated site-specific nucleases with enhanced specificity that are designed using the methods and strategies described herein. Some embodiments, of this invention provide nucleic acids encoding such nucleases. Some embodiments of this invention provide expression constructs comprising such encoding nucleic acids. For example, in some embodiments an isolated nuclease is provided that has been engineered to cleave a desired target site within a genome, and has been evaluated according to a method provided herein to cut less than 1, less than 2, less than 3, less than 4, less than 5, less than 6, less than 7, less than 8, less than 9 or less than 10 off-target sites at a concentration effective for the nuclease to cut its intended target site. In some embodiments an isolated nuclease is provided that has been engineered to cleave a desired unique target site that has been selected to differ from any other site within a genome by at least 3, at least 4, at least 5, at least 6, at least 7, at least 8, at least 9, or at least 10 nucleotide residues. In some embodiments, the isolated nuclease is a Zinc Finger Nuclease (ZFN) or a Transcription Activator-Like Effector Nuclease (TALEN), a homing endonuclease, or is or comprises an organic compound nuclease, an enediyne, an antibiotic nuclease, dynemicin, neocarzinostatin, calicheamicin, esperamicin, bleomycin, or a derivative thereof. In some embodiments, the isolated nuclease cleaves a consensus target site within an allele that is associated with a disease or disorder. In some embodiments, the isolated nuclease cleaves a consensus target site the cleavage of which results in treatment or prevention of a disease or disorder. In some embodiments, the disease is HIV/AIDS, or a proliferative disease. In some embodiments, the allele is a CCR5 (for treating HIV/AIDS) or a VEGFA allele (for treating a proliferative disease).

In some embodiments, the isolated nuclease is provided as part of a pharmaceutical composition. For example, some embodiments provide pharmaceutical compositions comprising a nuclease as provided herein, or a nucleic acid encoding such a nuclease, and a pharmaceutically acceptable excipient. Pharmaceutical compositions may optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with a nuclease or a nuclease-encoding nucleic acid ex vivo, and re-administered to the subject after the desired genomic modification has been effected or detected in the cells. Although the descriptions of pharmaceutical compositions provided herein are principally directed to pharmaceutical compositions which are suitable for administration to humans, it will be understood by the skilled artisan that such compositions are generally suitable for administration to animals of all sorts. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, shaping and/or packaging the product into a desired single- or multi-dose unit.

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid hinders, lubricants and the like, as suited to the particular dosage form desired. Remington's *The Science and Practice of Pharmacy*, 21st Edition, A. R. Gennaro (Lippincott, Williams & Wilkins, Baltimore, Md., 2006; incorporated herein by reference) discloses various excipients used in formulating pharmaceutical compositions and known techniques for the preparation thereof. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this invention.

The function and advantage of these and other embodiments of the present invention will be more fully understood from the Examples below. The following Examples are intended to illustrate the benefits of the present invention and to describe particular embodiments, but are not intended to exemplify the full scope of the invention. Accordingly, it will be understood that the Examples are not meant to limit the scope of the invention.

EXAMPLES

Example 1—Zinc Finger Nucleases

Introduction

Zinc finger nucleases (ZFNs) are enzymes engineered to recognize and cleave desired target DNA sequences. A ZFN monomer consists of a zinc finger DNA-binding domain fused with a non-specific FokI restriction endonuclease cleavage domain[1]. Since the FokI nuclease domain must dimerize and bridge two DNA half-sites to cleave DNA[2], ZFNs are designed to recognize two unique sequences flanking a spacer sequence of variable length and to cleave only when bound as a dimer to DNA. ZFNs have been used for genome engineering in a variety of organisms including mammals[3-9] by stimulating either non-homologous end joining or homologous recombination. In addition to providing powerful research tools, ZFNs also have potential as gene therapy agents. Indeed, two ZFNs have recently entered clinical trials: one as part of an anti-HIV therapeutic approach (NCT00842634, NCT01044654, NCT01252641) and the other to modify cells used as anti-cancer therapeutics (NCT01082926).

DNA cleavage specificity is a crucial feature of ZFNs. The imperfect specificity of some engineered zinc fingers domains has been linked to cellular toxicity[10] and therefore determining the specificities of ZFNs is of significant interest. ELISA assays[11], microarrays[12], a bacterial one-hybrid system[13], SELEX and its variants[14-16], and Rosetta-based computational predictions[17] have all been used to characterize the DNA-binding specificity of monomeric zinc finger domains in isolation. However, the toxicity of ZFNs is believed to result from DNA cleavage, rather than binding alone[18,19]. As a result, information about the specificity of zinc finger nucleases to date has been based on the unproven assumptions that (i) dimeric zinc finger nucleases cleave DNA with the same sequence specificity with which isolated monomeric zinc finger domains bind DNA; and (ii) the binding of one zinc finger domain does not influence the binding of the other zinc finger domain in a given ZFN. The DNA-binding specificities of monomeric zinc finger domains have been used to predict potential off-target cleavage sites of dimeric ZFNs in genomes[6,20], but to our knowledge no study to date has reported a method for determining the broad DNA cleavage specificity of active, dimeric zinc finger nucleases.

In this work we present an in vitro selection method to broadly examine the DNA cleavage specificity of active ZFNs. Our selection was coupled with high-throughput DNA sequencing technology to evaluate two obligate heterodimeric ZFNs, CCR5-224[6], currently in clinical trials (NCT00842634, NCT01044654, NCT01252641), and VF2468[4], that targets the human VEGF-A promoter, for their abilities to cleave each of $10^{11}$ potential target sites. We identified 37 sites present in the human genome that can be cleaved in vitro by CCR5-224, 2,652 sites in the human genome that can be cleaved in vitro by VF2468, and hundreds of thousands of in vitro cleavable sites for both ZFNs that are not present in the human genome. To demonstrate that sites identified by our in vitro selection can also be cleaved by ZFNs in cells, we examined 34 or 90 sites for evidence of ZFN-induced mutagenesis in cultured human K562 cells expressing the CCR5-224 or VF2468 ZFNs, respectively. Ten of the CCR5-224 sites and 32 of the VF2468 sites we tested show DNA sequence changes consistent with ZFN-mediated cleavage in human cells, although we anticipate that cleavage is likely to be dependent on cell type and ZFN concentration. One CCR5-224 off-target site lies in a promoter of the malignancy-associated BTBD10 gene.

Our results, which could not have been obtained by determining binding specificities of monomeric zinc finger domains alone, indicate that excess DNA-binding energy results in increased off-target ZFN cleavage activity and suggest that ZFN specificity can be enhanced by designing ZFNs with decreased binding affinity, by lowering ZFN expression levels, and by choosing target sites that differ by at least three base pairs from their closest sequence relatives in the genome.

Results

In Vitro Selection for ZFN-Mediated DNA Cleavage

Figure 5:
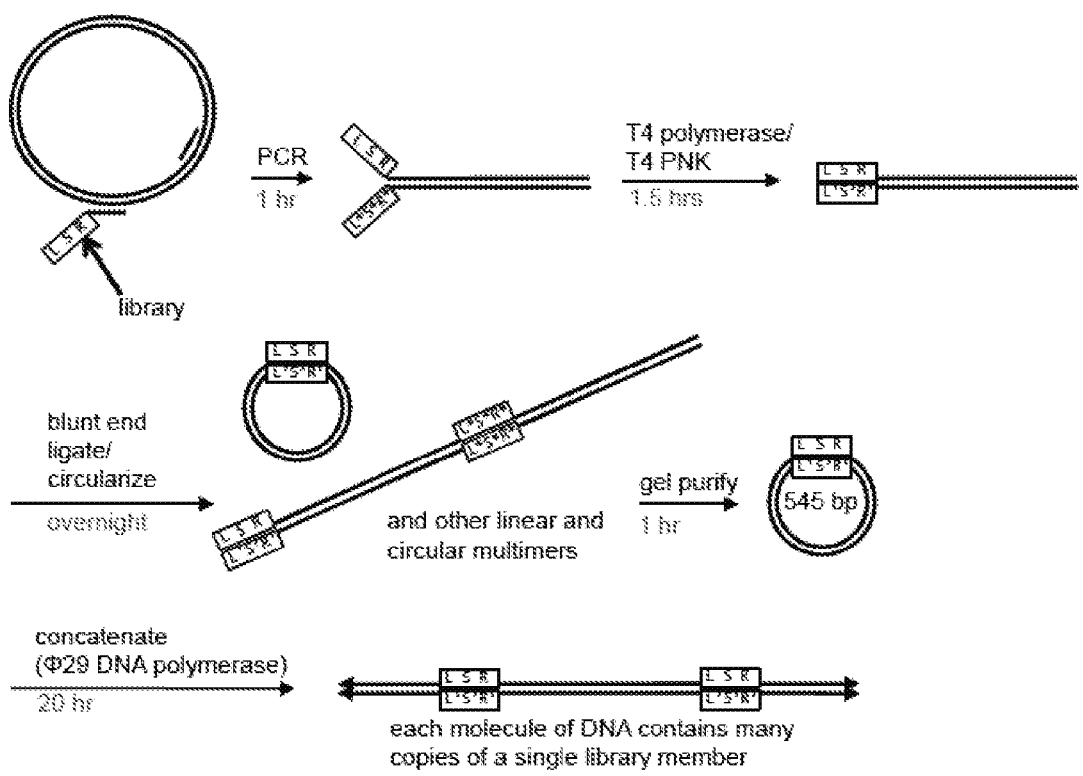
FIG. 5. In vitro synthesis of target site library. Library members consist of a partially randomized left-half site (L), a fully randomized 4-7 nucleotide spacer sequence (S), and a partially randomized right-half site (R). Library members present on DNA primers were incorporated into a linear ~545 base pair double-stranded DNA by PCR. During PCR, a primer with a library member (L S R) can anneal to a DNA strand with a different library member (L*S*R*), resulting in a double-strand DNA with two different library members at one end. The 3'-5' exonuclease and 5'-3' polymerase activities of T4 DNA polymerase removed mismatched library members and replaced them with complementary, matched library members (L'S'R'). After 5' phosphorylation with T4 polynucleotide kinase, the library DNA was subjected to blunt-end ligation, resulting in a mixture of linear and circular monomeric and multimeric species. Circular monomers were purified by gel electrophoresis and concatenated through rolling-circle amplification with Φ29 DNA polymerase.

Libraries of potential cleavage sites were prepared as double-stranded DNA using synthetic primers and PCR (FIG. 5). Each partially randomized position in the primer was synthesized by incorporating a mixture containing 79% wild-type phosphoramidite and 21% of an equimolar mixture of all three other phosphoramidites. Library sequences therefore differed from canonical ZFN cleavage sites by 21% on average, distributed binomially. We used a blunt ligation strategy to create a $10^{12}$-member minicircle library. Using rolling-circle amplification, >$10^{11}$ members of this library were both amplified and concatenated into high molecular weight (>12 kb) DNA molecules. In theory, this library covers with at least 10-fold excess all DNA sequences that are seven or fewer mutations from the wild-type target sequences.

Figure 6:
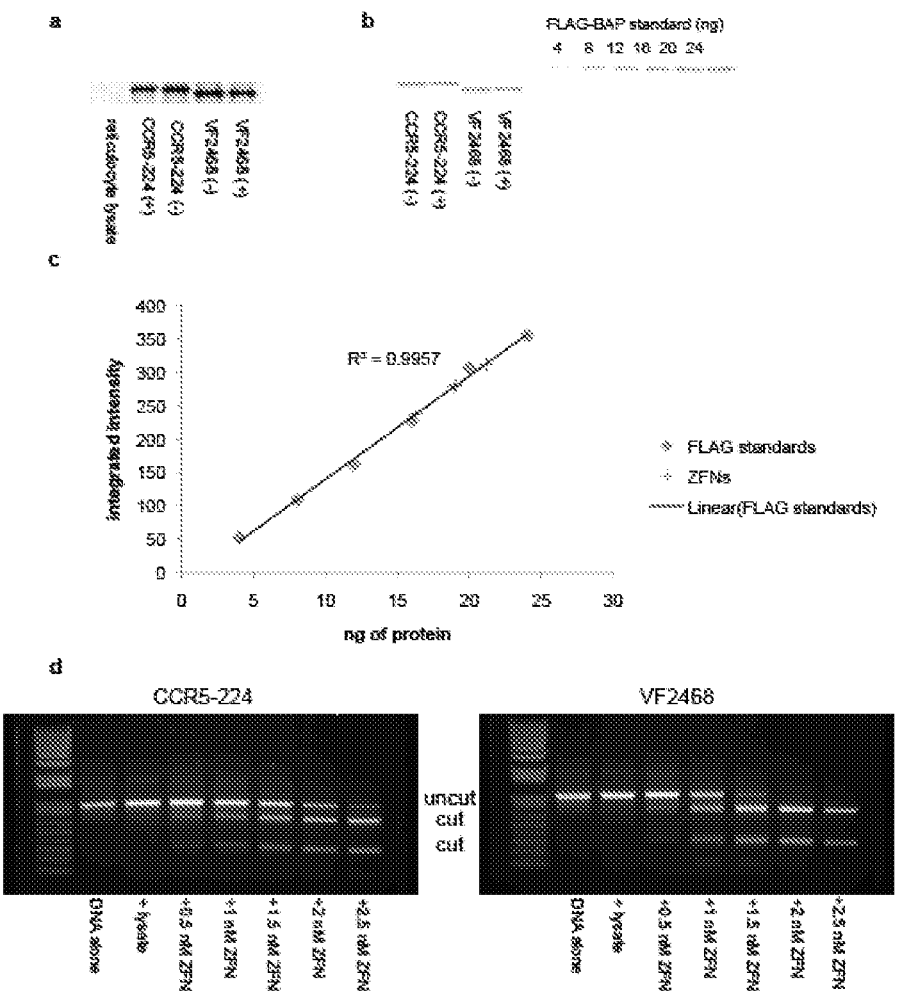
FIG. 6. Expression and quantification of ZFNs. Western blots for CCR5-224 and VF2468 are shown (a) for the ZFN samples used in the in vitro selection, and (b) for quantification. (c) Known quantities of N-terminal FLAG-tagged bacterial alkaline phosphatase (FLAG-BAP) were used to generate a standard curve for ZFN quantification. Diamonds represent the intensities of FLAG-BAP standards from the Western blot shown in (b), plus signs represent the intensities of bands of ZFNs, and the line shows the best-fit curve of FLAG-BAP standards that was used to quantify ZFNs. (d) Gels are shown of activity assays of CCR5-224 and VF2468 on an 8 nM linear substrate containing one target cleavage site. The ZFNs were each incubated with their respective substrate for 4 hours at 37° C. DNA in the "+lysate" lane was incubated with an amount of in vitro transcription/translation mixture equivalent to that used in the 2.5 nM ZFN reaction. ZFN-mediated cleavage results in two linear fragments approximately 700 bp and 300 bp in length. 2 nM CCR5-224 and 1 nM VF2468 were the amounts required for 50% cleavage of the linear substrate.
Figure 7:
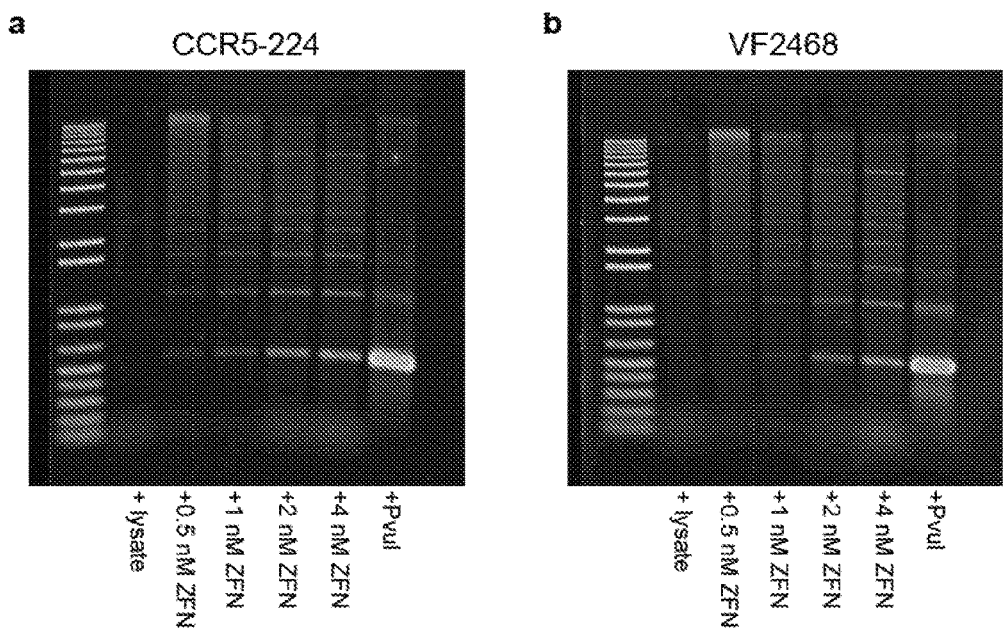
FIG. 7. Library cleavage with ZFNs. Cleavage of 1 μg of concatemeric libraries of CCR5-224 (a) or VF2468(b) target sites are shown with varying amounts CCR5-224 or VF2468, respectively. The lane labeled "+lysate" refers to pre-selection concatemeric library incubated with the volume of in vitro transcription/translation mixture contained in the samples containing 4 nM CCR5-224 or 4 nM of VF2468. Uncut DNA, which would be observed in the "+lysate" lane, is of length >12 kb and is lost upon purification due to its size and therefore is not present on the gel. The lane labeled "+PvuI" is a digest of the pre-selection library at PvuI sites introduced adjacent to library members. The laddering on the gels results from cleavage of pre-selection DNA concatemers at more than one site. There is a dose dependent increase in the amount of the bottom band, which corresponds to cleavage at two adjacent library sites in the same pre-selection DNA molecule. This bottom band of DNA was enriched by PCR and gel purification before sequencing.
Figure 8:
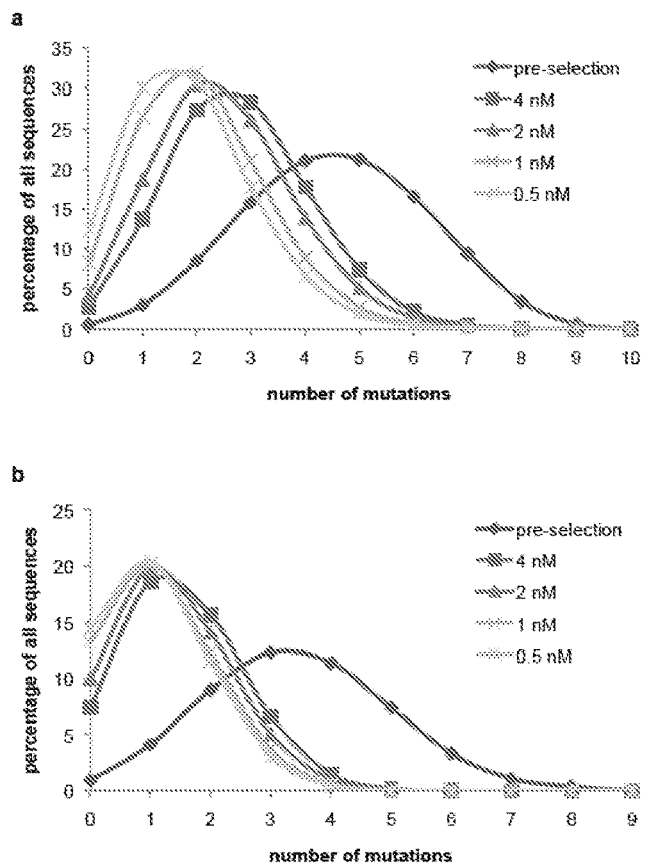
FIG. 8. ZFN off-target cleavage is dependent on enzyme concentration. For both (a) CCR5-224 and (b) VF2468 the distribution of cleavable sites revealed by in vitro selection shifts to include sites that are less similar to the target site as the concentration of ZFN increases. Both CCR5-224 and VF2468 selections enrich for sites that have fewer mutations than the pre-selection library. For comparisons between preselection and post-selection library means for all combinations of selection stringencies, P-values are 0 with the exception of the comparison between 0.5 nM and 1 nM VF2468 selections, which has a P-value of $1.7 \times 10^{-14}$.

We incubated the CCR5-224 or VF2468 DNA cleavage site library at a total cleavage site concentration of 14 nM with two-fold dilutions, ranging from 0.5 nM to 4 nM, of crude in vitro-translated CCR5-224 or VF2468, respectively (FIG. 6). Following digestion, we subjected the resulting DNA molecules (FIG. 7) to in vitro selection for DNA cleavage and subsequent paired-end high-throughput DNA sequencing. Briefly, three selection steps (FIG. 1) enabled the separation of sequences that were cleaved from those that were not. First, only sites that had been cleaved contained 5' phosphates, which are necessary for the ligation of adapters required for sequencing. Second, after PCR, a gel purification step enriched the smaller, cleaved library members. Finally, a computational filter applied after sequencing only counted sequences that have filled-in, complementary 5' overhangs on both ends, the hallmark for cleavage of a target site concatemer (Table 2 and Protocols 1-9). We prepared pre-selection library sequences for sequencing by cleaving the library at a PvuI restriction endonuclease recognition site adjacent to the library sequence and subjecting the digestion products to the same protocol as the ZFN-digested library sequences. High-throughput sequencing confirmed that the rolling-circle-amplified, pre-selection library contained the expected distribution of mutations (FIG. 8).

Design of an In Vitro Selection for ZFN-Mediated DNA Cleavage.

Figure 1:
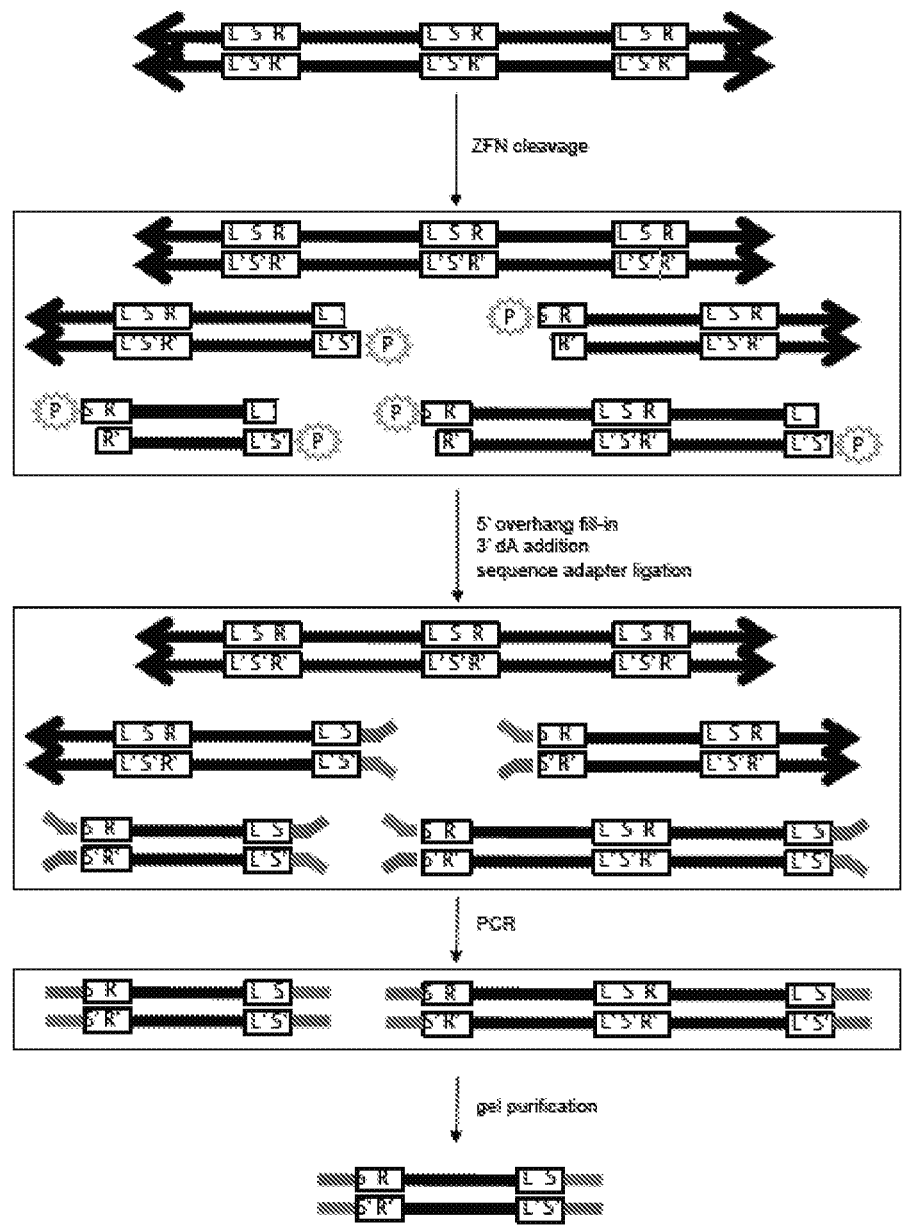
FIG. 1. In vitro selection for ZFN-mediated cleavage. Pre-selection library members are concatemers (represented by arrows) of identical ZFN target sites lacking 5' phosphates. L=left half-site; R=right half-site, S=spacer; L', S', R'=complementary sequences to L, S, R. ZFN cleavage reveals a 5' phosphate, which is required for sequencing adapter ligation. The only sequences that can be amplified by PCR using primers complementary to the adapters are sequences that have been cleaved twice and have adapters on both ends. DNA cleaved at adjacent sites are purified by gel electrophoresis and sequenced. A computational screening step after sequencing ensures that the filled-in spacer sequences (S and S') are complementary and therefore from the same molecule.

To characterize comprehensively the DNA cleavage specificity of active ZFNs, we first generated a large library of potential DNA substrates that can be selected for DNA cleavage in one step without requiring iterative enrichment steps that could amplify noise and introduce bias. We designed the substrate library such that each molecule in the library is a concatemer of one of >$10^{11}$ potential substrate sequences (FIG. 5). Incubation with ZFN results in some molecules that are uncut, some that have been cut once, and some that have been cut at least twice. Those molecules that have been cleaved at least twice have ends consisting of each half of the cleaved DNA sequence (FIG. 1). Cut library members are enriched relative to uncut library members in three ways (FIG. 1). First, sequences that have been cleaved twice have two complementary 5' overhangs, which can be identified computationally following DNA sequencing as hallmarks of bona fide cleavage products. Second, since ZFN-mediated cleavage reveals 5' phosphates that are not present in the pre-selection library, only DNA that has undergone cleavage is amenable to sequencing adapter ligation. Third, after PCR using primers complementary to the sequencing adapters, a gel purification step ensures that all sequenced material is of a length consistent with library members that have been cleaved at two adjacent sites. This gel-purified material is subjected to high-throughput DNA sequencing using the Illumina method (Bentley, D. R. et al. Accurate whole human genome sequencing using reversible terminator chemistry. Nature 456, 53-9 (2008)). Ideally, the library used in a ZFN cleavage selection would consist of every possible DNA sequence of the length recognized by the ZFN. Only one out of every 105 members of such a library, however, would contain a sequence that was within seven mutations of a 24-base pair recognition sequence. Since off-target recognition sequences most likely resemble target recognition sites, we used instead a biased library that ensures >10-fold coverage of all half-site sequences that differ from the wild-type recognition sequences by up to seven mutations. Library members consist of a fully randomized base pair adjacent to the 5' end of the recognition site, two partially randomized half sites flanking a 4-, 5-, 6-, or 7-bp fully randomized spacer, and another fully randomized base pair adjacent to the 3' end of the recognition site. A fully randomized five-base pair tag follows each library member. This tag, along with the randomized flanking base pairs and the randomized spacer sequence, was used as a unique identifier "key" for each library member. If this unique key was associated with more than one sequence read containing identical library members, these duplicate sequencing reads likely arose during PCR amplification and were therefore treated as one data point.

Analysis of CCR5-224 and VF2468 ZFNs Using the DNA Cleavage Selection.

Each member of a sequence pair consisted of a fragment of the spacer, an entire half-site, an adjacent nucleotide, and constant sequence. One end of the spacer was generally found in one sequence and the other end in its corresponding paired sequence, with the overhang sequence present in both paired sequence reads because overhangs were blunted by extension prior to ligation of adapters. The spacer sequences were reconstructed by first identifying the shared overhang sequence and then any nucleotides present between the overhang sequence and the half-site sequence. Only sequences containing no ambiguous nucleotides and overhangs of at least 4 nucleotides were analyzed. Overall, this computational screen for unique sequences that originated from two cleavage events on identical library members yielded 2.0 million total reads of cleaved library members (Table 2). There are far fewer analyzed sequences for the 0.5 nM, 1 nM, and 2 nM CCR5-224 and VF2468 selections compared to the 4 nM selections due to the presence of a large number of sequence repeats, identified through the use of the unique identifier key described above. The high abundance of repeated sequences in the 0.5 nM, 1 nM, and 2 nM selections indicate that the number of sequencing reads obtained in those selections, before repeat sequences were removed, was larger than the number of individual DNA sequences that survived all experimental selection steps. We estimated the error rate of sequencing to be 0.086% per nucleotide by analysis of a constant nucleotide in all paired reads. Using this error rate, we estimate that 98% of the post-selection ZFN target site sequences contain no errors.

Off-Target Cleavage is Dependent on ZFN Concentration

Figure 9:
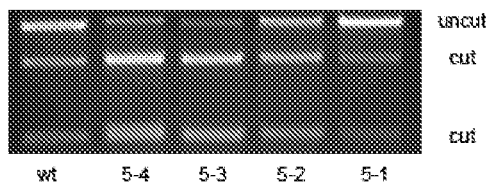
FIG. 9. Cleavage efficiency of individual sequences is related to selection stringency. In vitro DNA digests were performed on sequences identified in selections of varying stringencies (marked with 'X's). 2 nM CCR5-224 (SEQ ID NOs:7-14) (a) or 1 nM VF2468 (SEQ ID NOs:15-24) (b) was incubated with 8 nM of linear substrate containing the sequence shown. The 1 kb linear substrate contained a single cleavage site with the spacer sequence found in the genomic target of CCR5-224 ("CTGAT") or VF2468 ("TCGAA") and the indicated (+) and (−) half-sites. Mutant base pairs are represented with lowercase letters. CCR5-224 sites and VF2468 sites that were identified in the highest stringency selections (0.5 nM ZFN) are cleaved most efficiently, while sites that were identified only in the lowest stringency selections (4 nM ZFN) are cleaved least efficiently.
Figure 9:
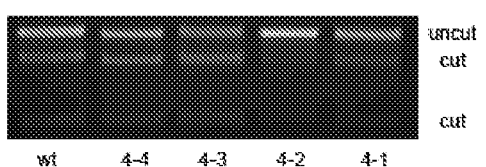

As expected, only a subset of library members was cleaved by each enzyme. The pre-selection libraries for CCR5-224 and VF2468 contained means of 4.56 and 3.45 mutations per complete target site (two half-sites), respectively, while post-selection libraries exposed to the highest concentrations of ZFN used (4 nM CCR5-224 and 4 nM VF2468) had means of 2.79 and 1.53 mutations per target site, respectively (FIG. 8). As ZFN concentration decreased, both ZFNs exhibited less tolerance for off-target sequences. At the lowest concentrations (0.5 nM CCR5-224 and 0.5 nM VF2468), cleaved sites contained an average of 1.84 and 1.10 mutations, respectively. We placed a small subset of the identified sites in a new DNA context and incubated in vitro with 2 nM CCR5-224 or 1 nM VF2468 for 4 hours at 37° C. (FIG. 9). We observed cleavage for all tested sites and those sites emerging from the more stringent (low ZFN concentration) selections were cleaved more efficiently than those from the less stringent selections. Notably, all of the tested sequences contain several mutations, yet some were cleaved in vitro more efficiently than the designed target.

Figure 10:
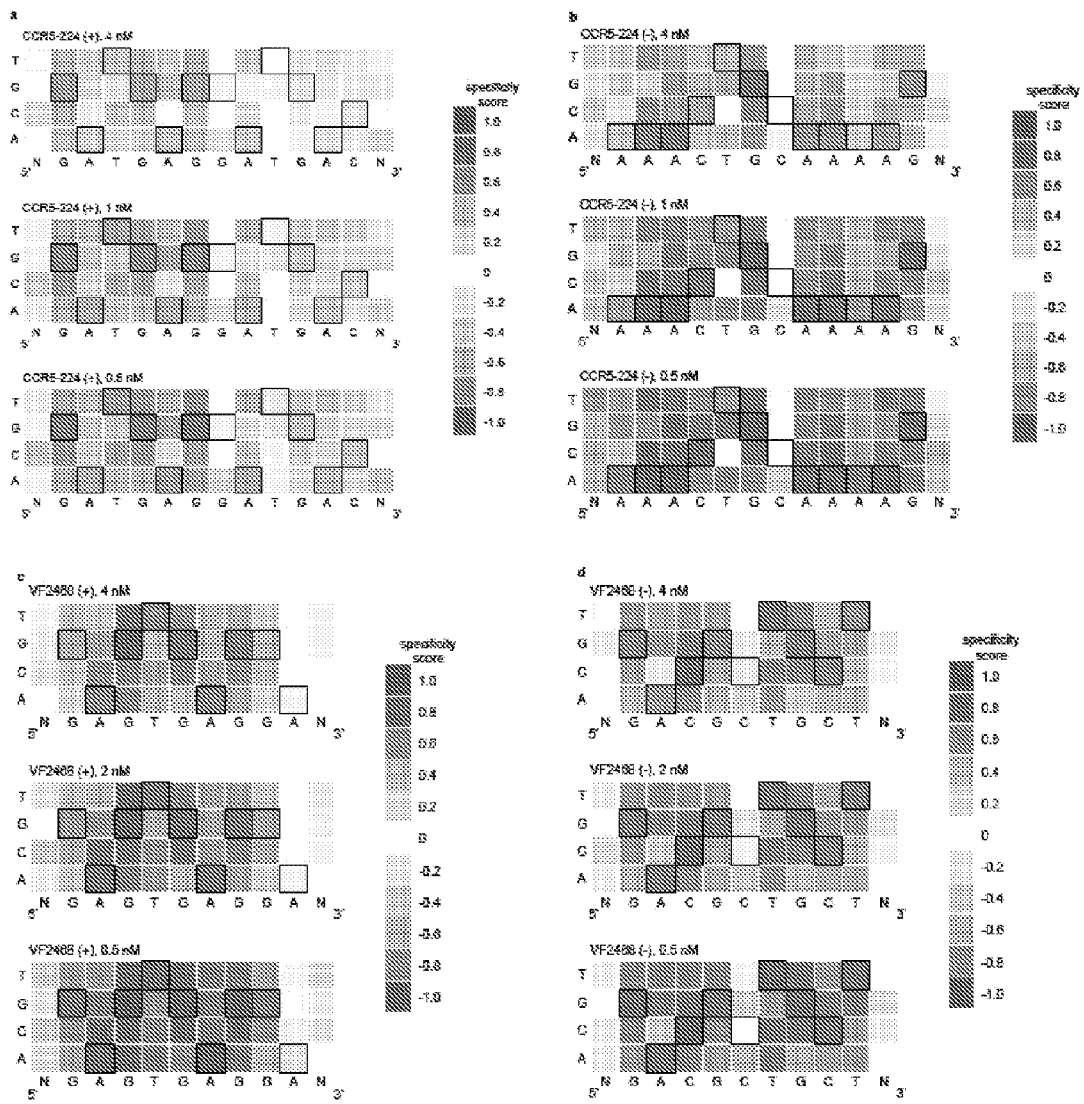
FIG. 10. Concentration-dependent sequence profiles for CCR5-224 and VF2468 ZFNs. The heat maps show specificity scores for the cleavage of 14 nM of total DNA library with varying amounts of CCR5-224 (FIGS. 10a and 10b) or VF2468 (FIGS. 10c and 10d). The target DNA sequence is shown below each half-site. Black boxes indicate target base pairs. Specificity scores were calculated by dividing the change in frequency of each base pair at each position in the post-selection DNA pool compared to the pre-selection pool by the maximal possible change in frequency of each base pair at each position. Blue boxes indicate specificity for a base pair at a given position, white boxes indicate no specificity, and red boxes indicate specificity against a base pair at a given position. The darkest blue shown in the legend corresponds to absolute preference for a given base pair (specificity score=1.0), while the darkest red corresponds to an absolute preference against a given base pair (specificity score=−1.0).

The DNA-cleavage specificity profile of the dimeric CCR5-224 ZFN (FIG. 2a and FIG. 10a,b) was notably different than the DNA-binding specificity profiles of the CCR5-224 monomers previously determined by SELEX[6]. For example, some positions, such as (+)A5 and (+)T9, exhibited tolerance for off-target base pairs in our cleavage selection that were not predicted by the SELEX study. VF2468, which had not been previously characterized with respect to either DNA-binding or DNA-cleavage specificity, revealed two positions, (−)C5 and (+)A9, that exhibited limited sequence preference, suggesting that they were poorly recognized by the ZFNs (FIG. 2b and FIG. 10c,d).

Compensation Between Half-Sites Affects DNA Recognition

Figure 3:
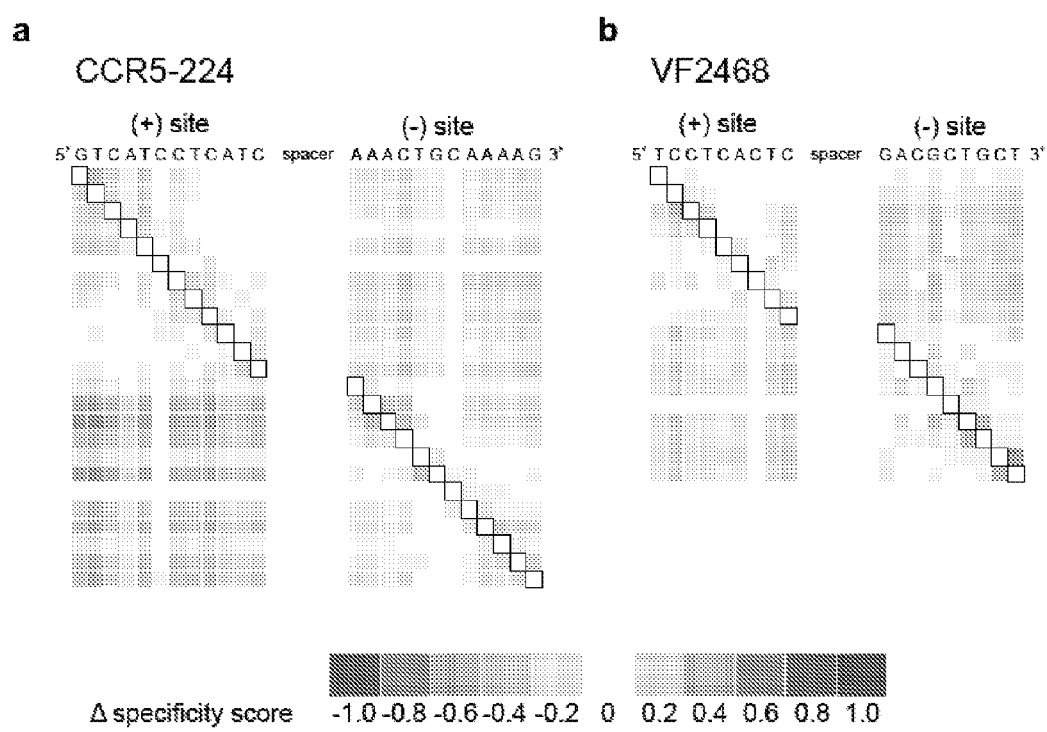
FIG. 3. Evidence for a compensation model of ZFN target site recognition. The heat maps show the changes in specificity score upon mutation at the black-boxed positions in selections with (a) 2 nM CCR5-224 (SEQ ID NOs:5-6) or (b) 1 nM VF2468. Each row corresponds to a different mutant position (explained graphically in FIG. 12). Sites are listed in their genomic orientation; the (+) half-site of CCR5-224 and the (+) half-site of VF2468 are therefore listed as reverse complements of the sequences found in FIG. 2. Shades of blue indicate increased specificity score (more stringency) when the black boxed position is mutated and shades of red indicate decreased specificity score (less stringency).
Figure 12:
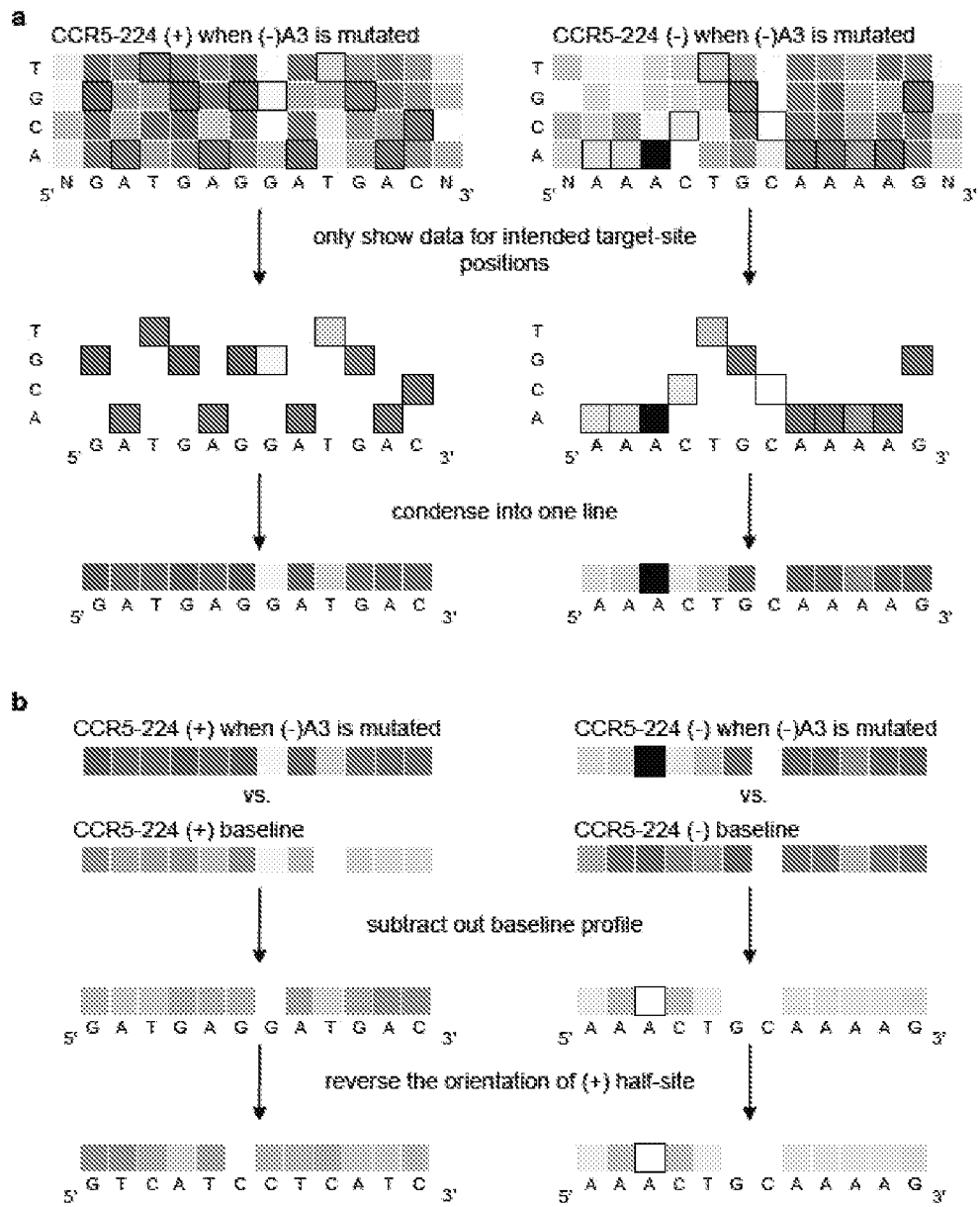
FIG. 12. Data processing steps used to create mutation compensation difference maps (SEQ ID NOs:31-39). The steps to create each line of the difference map in FIG. 3 are shown for the example of a mutation at position (−)A3. (a)

Our results reveal that ZFN substrates with mutations in one half-site are more likely to have additional mutations in nearby positions in the same half-site compared to the pre-selection library and less likely to have additional mutations in the other half-site. While this effect was found to be largest when the most strongly recognized base pairs were mutated (FIG. 11), we observed this compensatory phenomenon for all specified half-site positions for both the CCR5 and VEGF-targeting ZFNs (FIG. 3 and FIG. 12). For a minority of nucleotides in cleaved sites, such as VF2468 target site positions (+)G1, (−)G1, (−)A2, and (−)C3, mutation led to decreased tolerance of mutations in base pairs in the other half-site and also a slight decrease, rather than an increase, in mutational tolerance in the same half-site. When two of these mutations, (+)G1 and (−)G1, were enforced at the same time, mutational tolerance at all other positions decreased (FIG. 13). Collectively, these results show that tolerance of mutations at one half-site is influenced by DNA recognition at the other half-site.

This compensation model for ZFN site recognition applies not only to non-ideal half-sites, but also to spacers with non-ideal lengths. In general, the ZFNs cleaved at characteristic locations within the spacers (FIG. 14), and five- and six-base pair spacers were preferred over four- and seven-base pair spacers (FIGS. 15 and 16). However, cleaved sites with five- or six-base pair spacers showed greater sequence tolerance at the flanking half-sites than sites with four- or seven-base pair spacers (FIG. 17). Therefore, spacer imperfections, similar to half-site mutations, lead to more stringent in vitro recognition of other regions of the DNA substrate.

ZFNs can Cleave Many Sequences with Up to Three Mutations

Figure 4:
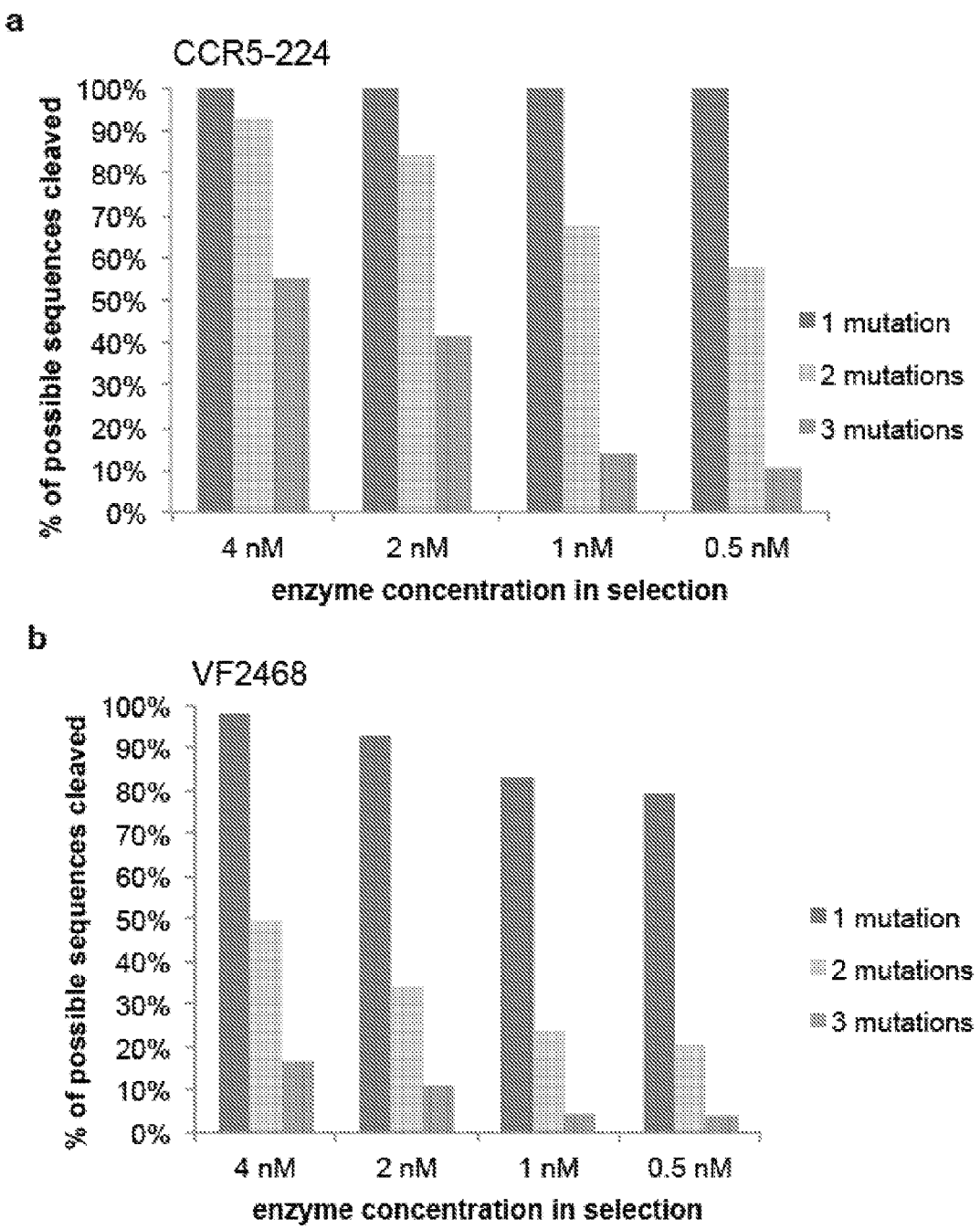
FIG. 4. ZFNs can cleave a large fraction of target sites with three or fewer mutations in vitro. The percentages of the sequences with one, two, or three mutations that are enriched for in vitro cleavage (enrichment factor>1) by the (a) CCR5-224 ZFN and (b) VF2468 ZFN are shown. Enrichment factors are calculated for each sequence identified in the selection by dividing the observed frequency of that sequence in the post-selection sequenced library by the frequency of that sequence in the pre-selection library.

We calculated enrichment factors for all sequences containing three or fewer mutations by dividing each sequence's frequency of occurrence in the post-selection libraries by its frequency of occurrence in the pre-selection libraries. Among sequences enriched by cleavage (enrichment factor >1), CCR5-224 was capable of cleaving all unique single-mutant sequences, 93% of all unique double-mutant sequences, and half of all possible triple-mutant sequences (FIG. 4a and Table 3a) at the highest enzyme concentration used. VF2468 was capable of cleaving 98% of all unique single-mutant sequences, half of all unique double-mutant sequences, and 17% of all triple-mutant sequences (FIG. 4b and Table 3b).

Since our approach assays active ZFN dimers, it reveals the complete sequences of ZFN sites that can be cleaved. Ignoring the sequence of the spacer, the selection revealed 37 sites in the human genome with five- or six-base pair spacers that can be cleaved in vitro by CCR5-224 (Table 1 and Table 4), and 2,652 sites in the human genome that can be cleaved by VF2468 (VF2468 Data). Among the genomic sites that were cleaved in vitro by VF2468, 1,428 sites had three or fewer mutations relative to the canonical target site (excluding the spacer sequence). Despite greater discrimination against single-, double-, and triple-mutant sequences by VF2468 compared to CCR5-224 (FIG. 4 and Table 3), the larger number of in vitro-cleavable VF2468 sites reflects the difference in the number of sites in the human genome that are three or fewer mutations away from the VF2468 target site (3,450 sites) versus those that are three or fewer mutations away from the CCR5-224 target site (eight sites) (Table 5).

Identified Sites are Cleaved by ZFNs in Human Cells

We tested whether CCR5-224 could cleave at sites identified by our selections in human cells by expressing CCR5-224 in K562 cells and examining 34 potential target sites within the human genome for evidence of ZFN-induced mutations using PCR and high-throughput DNA sequencing. We defined sites with evidence of ZFN-mediated cleavage as those with insertion or deletion mutations (indels) characteristic of non-homologous end joining (NHEJ) repair (Table 6) that were significantly enriched (P<0.05) in cells expressing active CCR5-224 compared to control cells containing an empty vector. We obtained approximately 100,000 sequences or more for each site analyzed, which enabled the detection of sites that were significantly modified at frequencies of approximately 1 in 10,000. Our analysis identified ten such sites: the intended target sequence in CCR5, a previously identified sequence in CCR2, and eight other off-target sequences (Tables 1, 4, and 6), one of which lies within the promoter of the BTBD10 gene. The eight newly identified off-target sites are modified at frequencies ranging from 1 in 300 to 1 in 5,300. We also expressed VF2468 in cultured K562 cells and performed the above analysis for 90 of the most highly cleaved sites identified by in vitro selection. Out of the 90 VF2468 sites analyzed, 32 showed indels consistent with ZFN-mediated targeting in K562 cells (Table 7). We were unable to obtain site-specific PCR amplification products for three CCR5-224 sites and seven VF2468 sites and therefore could not analyze the occurrence of NHEJ at those loci. Taken together, these observations indicate that off-target sequences identified through the in vitro selection method include many DNA sequences that can be cleaved by ZFNs in human cells.

Discussion

The method presented here identified hundreds of thousands of sequences that can be cleaved by two active, dimeric ZFNs, including many that are present and can be cut in the genome of human cells. One newly identified cleavage site for the CCR5-224 ZFN is within the promoter of the BTBD10 gene. When downregulated, BTBD10 has been associated with malignancy[21] and with pancreatic beta cell apoptosis[22]. When upregulated, BTBD10 has been shown to enhance neuronal cell growth[23] and pancreatic beta cell proliferation through phosphorylation of Akt family proteins[22,23]. This potentially important off-target cleavage site as well as seven others we observed in cells were not identified in a recent study[6] that used in vitro monomer-binding data to predict potential CCR5-224 substrates.

We have previously shown that ZFNs that can cleave at sites in one cell line may not necessarily function in a different cell line[4], most likely due to local differences in chromatin structure. Therefore, it is likely that a different subset of the in vitro-cleavable off-target sites would be modified by CCR5-224 or VF2468 when expressed in different cell lines. Purely cellular studies of endonuclease specificity, such as a recent study of homing endonuclease off-target cleavage[24], may likewise be influenced by cell line choice. While our in vitro method does not account for some features of cellular DNA, it provides general, cell type-independent information about endonuclease specificity and off-target sites that can inform subsequent studies performed in cell types of interest. In addition, while our pre-selection library oversamples with at least 10-fold coverage all sequences within seven mutations of the intended ZFN target sites, the number of sequence reads obtained per selection (approximately one million) is likely insufficient to cover all cleaved sequences present in the post-selection libraries. It is therefore possible that additional off-target cleavage sites for CCR5-224 and VF2468 could be identified in the human genome as sequencing capabilities continue to improve.

Although both ZFNs we analyzed were engineered to a unique sequence in the human genome, both cleave a significant number of off-target sites in cells. This finding is particularly surprising for the four-finger CCR5-224 pair given that its theoretical specificity is 4,096-fold better than that of the three-finger VF2468 pair (CCR5-224 should recognize a 24-base pair site that is six base pairs longer than the 18-base pair VF2468 site). Examination of the CCR5-224 and VF2468 cleavage profiles (FIG. 2) and mutational tolerances of sequences with three or fewer mutations (FIG. 4) suggests different strategies may be required to engineer variants of these ZFNs with reduced off-target cleavage activities. The four-finger CCR5-224 ZFN showed a more diffuse range of positions with relaxed specificity and a higher tolerance of mutant sequences with three or fewer mutations than the three-finger VF2468 ZFN. For VF2468, re-optimization of only a subset of fingers may enable a substantial reduction in undesired cleavage events. For CCR5-224, in contrast, a more extensive re-optimization of many or all fingers may be required to eliminate off-target cleavage events.

We note that not all four- and three-finger ZFNs will necessarily be as specific as the two ZFNs tested in this study. Both CCR5-224 and VF2468 were engineered using methods designed to optimize the binding activity of the ZFNs. Previous work has shown that for both three-finger and four-finger ZFNs, the specific methodology used to engineer the ZFN pair can have a tremendous impact on the quality and specificity of nucleases[7,13,25,26].

Our findings have significant implications for the design and application of ZFNs with increased specificity. Half or more of all potential substrates with one or two site mutations could be cleaved by ZFNs, suggesting that binding affinity between ZFN and DNA substrate is sufficiently high for cleavage to occur even with suboptimal molecular interactions at mutant positions. We also observed that ZFNs presented with sites that have mutations in one half-site exhibited higher mutational tolerance at other positions within the mutated half-site and lower tolerance at positions in the other half-site. These results collectively suggest that in order to meet a minimum affinity threshold for cleavage, a shortage of binding energy from a half-site harboring an off-target base pair must be energetically compensated by excess zinc finger:DNA binding energy in the other half-site, which demands increased sequence recognition stringency at the non-mutated half-site (Fig. S18). Conversely, the relaxed stringency at other positions in mutated half-sites can be explained by the decreased contribution of that mutant half-site to overall ZFN binding energy. This hypothesis is supported by a recent study showing that reducing the number of zinc fingers in a ZFN can actually increase, rather than decrease, activity[27].

This model also explains our observation that sites with suboptimal spacer lengths, which presumably were bound less favorably by ZFNs, were recognized with higher stringency than sites with optimal spacer lengths. In vitro spacer preferences do not necessarily reflect spacer preferences in cells;[28,29] however, our results suggest that the dimeric FokI cleavage domain can influence ZFN target-site recognition. Consistent with this model, Wolfe and co-workers recently observed differences in the frequency of off-target events in zebrafish of two ZFNs with identical zinc-finger domains but different FokI domain variants.[20]

Collectively, our findings suggest that (i) ZFN specificity can be increased by avoiding the design of ZFNs with excess DNA binding energy; (ii) off-target cleavage can be minimized by designing ZFNs to target sites that do not have relatives in the genome within three mutations; and (iii) ZFNs should be used at the lowest concentrations necessary to cleave the target sequence to the desired extent. While this study focused on ZFNs, our method should be applicable to all sequence-specific endonucleases that cleave DNA in vitro, including engineered horning endonucleases and engineered transcription activator-like effector (TALE) nucleases. This approach can provide important information when choosing target sites in genomes for sequence-specific endonucleases, and when engineering these enzymes, especially for therapeutic applications.

Methods

Oligonucleotides and Sequences.

All oligonucleotides were purchased from Integrated DNA Technologies or Invitrogen and are listed in Table 8. Primers with degenerate positions were synthesized by Integrated DNA Technologies using hand-mixed phosphoramidites containing 79% of the indicated base and 7% of each of the other standard DNA bases.

Sequences of ZFNs Used in this Study.

DNA and protein sequences are shown for the ZFNs used in this study. The T7 promoter is underlined, and the start codon is in bold.

```
CCR5-224 (+) DNA sequence (SEQ ID NO: 119):
TAATACGACTCACTATAGGGAGACCCAAGCTGGCTAGCCACCATGGACTACAAAGACCATGACGGTGATTATAAA
GATCATGACATCGATTACAAGGATGACGATGACAAGATGGCCCCCAAGAAGAAGAGGAAGGTGGGCATTCACGGG
GTACCCGCCGCTATGGCTGAGAGGCCCTTCCAGTGTCGAATCTGCATGCGTAACTTCAGTGATCGCTCTAACCTG
AGTCGGCACATCCGCACCCACACAGGCGAGAAGCCTTTTGCCTGTGACATTTGTGGGAGGAAGTTTGCCATCTCC
TCCAACCTGAACTCCCATACCAAGATACACACGGGATCTCAGAAGCCCTTCCAGTGTCGAATCTGCATGCGTAAC
TTCAGTCGCTCCGACAACCTGGCCCGCCACATCCGCACCCACACAGGCGAGAAGCCTTTTGCCTGTGACATTTGT
GGGAGGAAATTTGCCACCTCCGGCAACCTGACCCGCCATACCAAGATACACCTGCGGGGATCCCAACTAGTCAAA
AGTGAACTGGAGGAGAAGAAATCTGAACTTCGTCATAAATTGAAATATGTGCCTCATGAATATATTGAATTAATT
GAAATTGCCAGAAATTCCACTCAGGATAGAATTCTTGAAATGAAGGTAATGGAATTTTTTATGAAAGTTTATGGA
TATAGAGGTAAACATTTGGGTGGATCAAGGAAACCGGACGGAGCAATTTATACTGTCGGATCTCCTATTGATTAC
GGTGTGATCGTGGATACTAAAGCTTATAGCGGAGGTTATAATCTGCCAATTGGCCAAGCAGATGAAATGCAACGA
TATGTCAAAGAAAATCAAACACGAAACAAACATATCAACCCTAATGAATGGTGGAAAGTCTATCCATCTTCTGTA
ACGGAATTTAAGTTTTTATTTGTGAGTGGTCACTTTAAAGGAAACTACAAAGCTCAGCTTACACGATTAAATCAT
AAGACTAATTGTAATGGAGCTGTTCTTAGTGTAGAAGAGCTTTTAATTGGTGGAGAAATGATTAAAGCCGGCACA
TTAACCTTAGAGGAAGTGAGACGGAAATTTAATAACGGCGAGATAAACTTTTAA CCR5-224 (+) protein sequence (SEQ ID NO: 120):
MDYKDHDGDYKDHDIDYKDDDDKMAPKKKRKVGIHGVPAAMAERPFQCRICMRNFSDRSNLSRHIRTHTGEKPFA
CDICGRKFAISSNLNSHTKIHTGSQKPFQCRICMRNFSRSDNLARHIRTHTGEKPFACDICGRKFATSGNLTRHT
KIHLRGSQLVKSELEEKKSELRHKLKYVPHEYIELIEIARNSTQDRILEMKVMEFFMKVYGYRGKHLGGSRKPDG
AIYTVGSPIDYGVIVDTKAYSGGYNLPIGQADEMQRYVKENQTRNKHINPNEWWKVYPSSVTEFKFLFVSGHFKG
NYKAQLTRLNHKTNCNGAVLSVEELLIGGEMIKAGTLTLEEVRRKFNNGEINF CCR5-224 (-) DNA sequence (SEQ ID NO: 121):
TAATACGACTCACTATAGGGAGACCCAAGCTGGCTAGCCACCATGGACTACAAAGACCATGACGGTGATTATAAA
GATCATGACATCGATTACAAGGATGACGATGACAAGATGGCCCCCAAGAAGAAGAGGAAGGTGGGCATTCACGGG
GTACCTGCCGCTATGGCTGAGAGGCCCTTCCAGTGTCGAATCTGCATGCGTAACTTCAGTCGCTCCGACAACCTG
```

-continued

TCCGTGCACATCCGCACCCACACAGGCGAGAAGCCTTTTGCCTGTGACATTTGTGGGAGGAAGTTTGCCCAGAAG
ATCAACCTGCAGGTGCATACCAAGATACACACCGGCGAGAAGCCCTTCCAGTGTCGAATCTGCATGCGTAACTTC
AGTCGCTCCGACGTGCTGTCCGAGCACATCCGCACCCACACAGGCGAGAAGCCTTTTGCCTGTGACATTTGTGGG
AGGAAATTTGCCCAGCGCAACCACCGCACCACCCATACCAAGATACACCTGCGGGGATCCCAACTAGTCAAAAGT
GAACTGGAGGAGAAGAAATCTGAACTTCGTCATAAATTGAAATATGTGCCTCATGAATATATTGAATTAATTGAA
ATTGCCAGAAATTCCACTCAGGATAGAATTCTTGAAATGAAGGTAATGGAATTTTTTATGAAAGTTTATGGATAT
AGAGGTAAACATTTGGGTGGATCAAGGAAACCGGACGGAGCAATTTATACTGTCGGATCTCCTATTGATTACGGT
GTGATCGTGGATACTAAAGCTTATAGCGGAGGTTATAATCTGCCAATTGGCCAAGCAGATGAAATGGAGCGATAT
GTCGAAGAAAATCAAACACGAAACAAACATCTCAACCCTAATGAATGGTGGAAAGTCTATCCATCTTCTGTAACG
GAATTTAAGTTTTTATTTGTGAGTGGTCACTTTAAAGGAAACTACAAAGCTCAGCTTACACGATTAAATCATATC
ACTAATTGTAATGGAGCTGTTCTTAGTGTAGAAGAGCTTTTAATTGGTGGAGAAATGATTAAAGCCGGCACATTA
ACCTTAGAGGAAGTGAGACGGAAATTTAATAACGGCGAGATAAACTTTTAA

CCR5-224 (-) protein sequence (SEQ ID NO: 122):
MDYKDHDGDYKDHDIDYKDDDDKMAPKKKRKVGIHGVPAAMAERPFQCRICMRNFSRSDNLSVHIR
THTGEKPFACDICGRKFAQKINLQVHTKIHTGEKPFQCRICMRNFSRSDVLSEHIRTHTGEKPFACDICG
RKFAQRNHRTTHTKIHLRGSQLVKSELEEKKSELRHKLKYVPHEYIELIEIARNSTQDRILEMKVMEFF
MKVYGYRGKHLGGSRKPDGAIYTVGSPIDYGVIVDTKAYSGGYNLPIGQADEMERYVEENQTRNKHL
NPNEWWKVYPSSVIEFKFLFVSGHFKGNYKAQLTRLNHITNCNGAVLSVEELLIGGEMIKAGILTLEE
VRRKFNNGEINF VF2468 (+) DNA sequence (SEQ ID NO: 123):
<u>TAATACGACTCACTATAGG</u>GAGACCCAAGCTGGCTAGCCACCATGGACTACAAAGACCATGACGG
TGATTATAAAGATCATGACATCGATTACAAGGATGACGATGACAAGATGGCCCCAAGAAGAAGA
GGAAGGTGGGCATTCACGGGGTGCCGTCTAGACCCGGGGAGCGCCCCTTCCAGTGTCGCATTTGC
ATGCGGAACTTTTCGCGCCAGGACAGGCTTGACAGGCATACCCGTACTCATACCGGTGAAAAACC
GTTTCAGTGTCGGATCTGTATGCGAAATTTCTCCCAGAAGGAGCACTTGGCGGGCATCTACGTAC
GCACACCGGCGAGAAGCCATTCCAATGCCGAATATGCATGCGCAACTTCAGTCGCCGCGACAACC
TGAACCGGCACCTAAAAACCCACCTGAGGGGATCCCAACTAGTCAAAAGTGAACTGGAGGAGAA
GAAATCTGAACTTCGTCATAAATTGAAATATGTGCCTCATGAATATATTGAATTAATTGAAATTGC
CAGAAATTCCACTCAGGATAGAATTCTTGAAATGAAGGTAATGGAATTTTTTATGAAAGTTTATGG
ATATAGAGGTAAACATTTGGGTGGATCAAGGAAACCGGACGGAGCAATTTATACTGTCGGATCTC
CTATTGATTACGGTGTGATCGTGGATACTAAAGCTTATAGCGGAGGTTATAATCTGCCAATTGGCC
AAGCAGATGAAATGCAACGATATGTCAAAGAAAATCAAACACGAAACAAACATATCAACCCTAAT
GAATGGTGGAAAGTCTATCCATCTTCTGTAACGGAATTTAAGTTTTTATTTGTGAGTGGTCACTTTA
AAGGAAACTACAAAGCTCAGCTTACACGATTAAATCATAAGACTAATTGTAATGGAGCTGTTCTTA
GTGTAGAAGAGCTTTTAATTGGTGGAGAAATGATTAAAGCCGGCACATTAACCTTAGAGGAAGTG
AGACGGAAATTTAATAACGGCGAGATAAACTTTTAA VF2468 (+) protein sequence (SEQ ID NO: 124):
MDYKDHDGDYKDHDIDYKDDDDKMAPKKKRKVGIHGVPSRPGERPFQCRICMRNFSRQDRLDRHTR
THTGEKPFQCRICMRNFSQKEHLAGHLRTHTGEKPFQCRICMRNFSRRDNLNRHLKTHLRGSQLVKSE
LEEKKSELRHKLKYVPHEYIELIEIARNSTQDRILEMKVMEFFMKVYGYRGKHLGGSRKPDGAIYTVGS
PIDYGVIVDTKAYSGGYNLPIGQADEMQRYVKENQTRNKHINPNEWWKVYPSSVTEFKFLFVSGHFKG
NYKAQLTRLNHKTNCNGAVLSVEELLIGGEMIKAGTLTLEEVRRKFNNGEINF VF2468 (-) DNA sequence (SEQ ID NO: 125):
<u>TAATACGACTCACTATAGG</u>GAGACCCAAGCTGGCTAGCCACCATGGACTACAAAGACCATGACGG
TGATTATAAAGATCATGACATCGATTACAAGGATGACGATGACAAGATGGCCCCAAGAAGAAGA
GGAAGGTGGGCATTCACGGGGTGCCGTCTAGACCCGGGGAGCGCCCCTTCCAGTGTCGCATTTGC
ATGCGGAACTTTTCGACCGGCCAGATCCTTGACCGCCATACCCGTACTCATACCGGTGAAAAACCG
TTTCAGTGTCGGATCTGTATGCGAAATTTCTCCGTGGCCACAGCTTGAAGAGGCATCTACGTACG
CACACCGGCGAGAAGCCATTCCAATGCCGAATATGCATGCGCAACTTCAGTGACCCCAGCAACCT
GCGGCGCCACCTAAAAACCCACCTGAGGGGATCCCAACTAGTCAAAAGTGAACTGGAGGAGAAG
AAATCTGAACTTCGTCATAAATTGAAATATGTGCCTCATGAATATATTGAATTAATTGAAATTGCC
AGAAATTCCACTCAGGATAGAATTCTTGAAATGAAGGTAATGGAATTTTTTATGAAAGTTTATGGA
TATAGAGGTAAACATTTGGGTGGATCAAGGAAACCGGACGGAGCAATTTATACTGTCGGATCTCC
TATTGATTACGGTGTGATCGTGGATACTAAAGCTTATAGCGGAGGTTATAATCTGCCAATTGGCCA
AGCAGATGGAGCGATATGTCGAAGAAAATCAAACACGAAACAAACATCTCAACCCTAATG
AATGGTGGAAAGTCTATCCATCTTCTGTAACGGAATTTAAGTTTTTATTTGTGAGTGGTCACTTTAA
AGGAAACTACAAAGCTCAGCTTACACGATTAAATCATATCACTAATTGTAATGGAGCTGTTCTTAG
TGTAGAAGAGCTTTTAATTGGTGGAGAAATGATTAAAGCCGGCACATTAACCTTAGAGGAAGTGA
GACGGAAATTTAATAACGGCGAGATAAACTTTTAA VF2468 (-) protein sequence (SEQ ID NO: 126):
MDYKDHDGDYKDHDIDYKDDDDKMAPKKKRKVGIHGVPSRPGERPFQCRICMRNFSTGQILDRHTRT
HTGEKPFQCRICMRNFSVAHSLKRHLRTHTGEKPFQCRICMRNFSDPSNLRRHLKTHLRGSQLVKSELE
EKKSELRHKLKYVPHEYIELIEIARNSTQDRILEMKVMEFFMKVYGYRGKHLGGSRKPDGAIYTVGSPI
DYGVIVDTKAYSGGYNLPIGQADEMERYVEENQTRNKHLNPNEWWKVYPSSVTEFKFLFVSGHFKGN
YKAQLTRLNHITNCNGAVLSVEELLIGGEMIKAGILTLEEVRRKFNNGEINF Library Construction.

Libraries of target sites were incorporated into double-stranded DNA by PCR with Taq DNA Polymerase (NEB) on a pUC19 starting template with primers "N5-PvuI" and "CCR5-224-N4," "CCR5-224-N5," "CCR5-224-N6," "CCR5-224-N7," "VF2468-N4," "VF2468-N5," "VF2468-N6," or "VF2468-N7," yielding an approximately 545-bp product with a PvuI restriction site adjacent to the library sequence, and purified with the Qiagen PCR Purification Kit.

Library-encoding oligonucleotides were of the form 5' backbone-PvuI site-NNNNNN-partially randomized half-site-$N_{4-7}$-partially randomized half site-N-backbone 3'. The purified oligonucleotide mixture (approximately 10 μg) was blunted and phosphorylated with a mixture of 50 units of T4

Polynucleotide Kinase and 15 units of T4 DNA polymerase (NEBNext End Repair Enzyme Mix, NEB) in 1×NEBNext End Repair Reaction Buffer (50 mM Tris-HCl, 10 mM MgCl$_2$, 10 mM dithiothreitol, 1 mM ATP, 0.4 mM dATP, 0.4 mM dCTP, 0.4 mM dGTP, 0.4 mM dTTP, pH 7.5) for 1.5 hours at room temperature. The blunt-ended and phosphorylated DNA was purified with the Qiagen PCR Purification Kit according to the manufacturer's protocol, diluted to 10 ng/μL in NEB T4 DNA Ligase Buffer (50 mM Tris-HCl, 10 mM MgCl$_2$, 10 mM dithiothreitol, 1 mM ATP, pH 7.5) and circularized by ligation with 200 units of T4 DNA ligase (NEB) for 15.5 hours at room temperature. Circular monomers were gel purified on 1% TAE-Agarose gels. 70 ng of circular monomer was used as a substrate for rolling-circle amplification at 30° C. for 20 hours in a 100 μL reaction using the Illustra TempliPhi 100 Amplification Kit (GE Healthcare). Reactions were stopped by incubation at 65° C. for 10 minutes. Target site libraries were quantified with the Quant-iT PicoGreen dsDNA Reagent (Invitrogen). Libraries with $N_4$, $N_5$, $N_6$, and $N_7$ spacer sequences between partially randomized half-sites were pooled in equimolar concentrations for both CCR5-224 and VF2468.

Zinc Finger Nuclease Expression and Characterization.

3×FLAG-tagged zinc finger proteins for CCR5-224 and VF2468 were expressed as fusions to FokI obligate heterodimers[30] in mammalian expression vectors[4] derived from pMLM290 and pMLM292. DNA and protein sequences are provided elsewhere herein. Complete vector sequences are available upon request. 2 μg of ZFN-encoding vector was transcribed and translated in vitro using the T$_N$T Quick Coupled rabbit reticulocyte system (Promega). Zinc chloride (Sigma-Aldrich) was added at 500 μM and the transcription/translation reaction was performed for 2 hours at 30° C. Glycerol was added to a 50% final concentration. Western blots were used to visualize protein using the anti-FLAG M2 monoclonal antibody (Sigma-Aldrich). ZFN concentrations were determined by Western blot and comparison with a standard curve of N-terminal FLAG-tagged bacterial alkaline phosphatase (Sigma-Aldrich).

Test substrates for CCR5-224 and VF2468 were constructed by cloning into the HindIII/XbaI sites of pUC19. PCR with primers "test fwd" and "test rev" and Taq DNA polymerase yielded a linear 1 kb DNA that could be cleaved by the appropriate ZFN into two fragments of sizes ~300 bp and ~700 bp. Activity profiles for the zinc finger nucleases were obtained by modifying the in vitro cleavage protocols used by Miller et al.[30] and Cradick et al.[31]. 1 μg of linear 1 kb DNA was digested with varying amounts of ZFN in 1×NEBuffer 4 (50 mM potassium acetate, 20 mM Tris-acetate, 10 mM magnesium acetate, 1 mM dithiothreitol, pH 7.9) for 4 hours at 37° C. 100 μg of RNase A (Qiagen) was added to the reaction for 10 minutes at room temperature to remove RNA from the in vitro transcription/translation mixture that could interfere with purification and gel analysis. Reactions were purified with the Qiagen PCR Purification Kit and analyzed on 1% TAE-agarose gels.

In Vitro Selection.

ZFNs of varying concentrations, an amount of T$_N$T reaction mixture without any protein-encoding DNA template equivalent to the greatest amount of ZFN used ("lysate"), or 50 units PvuI (NEB) were incubated with 1 μg of rolling-circle amplified library for 4 hours at 37° C. in 1×NEBuffer 4 (50 mM potassium acetate, 20 mM Tris-acetate, 10 mM magnesium acetate, 1 mM dithiothreitol, pH 7.9). 100 μg of RNase A (Qiagen) was added to the reaction for 10 minutes at room temperature to remove RNA from the in vitro transcription/translation mixture that could interfere with purification and gel analysis. Reactions were purified with the Qiagen PCR Purification Kit. 1/10 of the reaction mixture was visualized by gel electrophoresis on a 1% TAE-agarose gel and staining with SYBR Gold Nucleic Acid Gel Stain (Invitrogen).

The purified DNA was blunted with 5 units DNA Polymerase I, Large (Klenow) Fragment (NEB) in 1×NEBuffer 2 (50 mM NaCl, 10 mM Tris-HCl, 10 mM MgCl$_2$, 1 mM dithiothreitol, pH 7.9) with 500 μM dNTP mix (Bio-Rad) for 30 minutes at room temperature. The reaction mixture was purified with the Qiagen PCR Purification Kit and incubated with 5 units of Klenow Fragment (3' exo$^-$) (NEB) for 30 minutes at 37° C. in 1×NEBuffer 2 (50 mM NaCl, 10 mM Tris-HCl, 10 mM MgCl$_2$, 1 mM dithiothreitol, pH 7.9) with 240 μM dATP (Promega) in a 50 μL final volume. 10 mM Tris-HCl, pH 8.5 was added to a volume of 90 μL and the reaction was incubated for 20 minutes at 75° C. to inactivate the enzyme before cooling to 12° C. 300 fmol of "adapter1/2", barcoded according to enzyme concentration, or 6 pmol of "adapter1/2" for the PvuI digest, were added to the reaction mixture, along with 10 ul 10×NEB T4 DNA Ligase Reaction Buffer (500 mM Tris-HCl, 100 mM MgCl$_2$, 100 mM dithiothreitol, 10 mM ATP). Adapters were ligated onto the blunt DNA ends with 400 units of T4 DNA ligase at room temperature for 17.5 hours and ligated DNA was purified away from unligated adapters with Illustra Microspin S-400 HR sephacryl columns (GE Healthcare). DNA with ligated adapters were amplified by PCR with 2 units of Phusion Hot Start II DNA Polymerase (NEB) and 10 pmol each of primers "PE1" and "PE2" in 1× Phusion GC Buffer supplemented with 3% DMSO and 1.7 mM MgCl$_2$. PCR conditions were 98° C. for 3 min, followed by cycles of 98° C. for 15 s, 60° C. for 15 s, and 72° C. for 15 s, and a final 5 min extension at 72° C. The PCR was run for enough cycles (typically 20-30) to see a visible product on gel. The reactions were pooled in equimolar amounts and purified with the Qiagen PCR Purification Kit. The purified DNA was gel purified on a 1% TAE-agarose gel, and submitted to the Harvard Medical School Biopolymers Facility for Illumina 36-base paired-end sequencing.

Data Analysis.

Illumina sequencing reads were analyzed using programs written in C++. Algorithms are described elsewhere herein (e.g., Protocols 1-9), and the source code is available on request. Sequences containing the same barcode on both paired sequences and no positions with a quality score of 'B' were binned by barcode. Half-site sequence, overhang and spacer sequences, and adjacent randomized positions were determined by positional relationship to constant sequences and searching for sequences similar to the designed CCR5-224 and VF2468 recognition sequences. These sequences were subjected to a computational selection step for complementary, filled-in overhang ends of at least 4 base pairs, corresponding to rolling-circle concatemers that had been cleaved at two adjacent and identical sites. Specificity scores were calculated with the formulae: positive specificity score=(frequency of base pair at position[post-selection]−frequency of base pair at position[pre-selection])/(1−frequency of base pair at position[pre-selection]) and negative specificity score=(frequency of base pair at position[post-selection]−frequency of base pair at position[pre-selection])/(frequency of base pair at position[pre-selection]).

Positive specificity scores reflect base pairs that appear with greater frequency in the post-selection library than in the starting library at a given position; negative specificity scores reflect base pairs that are less frequent in the post-selection library than in the starting library at a given position. A score of +1 indicates an absolute preference, a score of −1 indicates an absolute intolerance, and a score of 0 indicates no preference.

Assay of Genome Modification at Cleavage Sites in Human Cells.

CCR5-224 ZFNs were cloned into a CMV-driven mammalian expression vector in which both ZFN monomers were translated from the same mRNA transcript in stoichiometric quantities using a self-cleaving T2A peptide sequence similar to a previously described vector[32]. This vector also expresses enhanced green fluorescent protein (eGFP) from a PGK promoter downstream of the ZFN expression cassette. An empty vector expressing only eGFP was used as a negative control.

To deliver ZFN expression plasmids into cells, 15 µg of either active CCR5-224 ZFN DNA or empty vector DNA were used to Nucleofect 2×10⁶ K562 cells in duplicate reactions following the manufacturer's instructions for Cell Line Nucleofector Kit V (Lonza). GFP-positive cells were isolated by FACS 24 hours post-transfection, expanded, and harvested five days post-transfection with the QIAamp DNA Blood Mini Kit (Qiagen).

PCR for 37 potential CCR5-224 substrates and 97 potential VF2468 substrates was performed with Phusion DNA Polymerase (NEB) and primers "[ZFN] [#] fwd" and "[ZFN] [#] rev" (Table 9) in 1× Phusion HF Buffer supplemented with 3% DMSO. Primers were designed using Primer3[33]. The amplified DNA was purified with the Qiagen PCR Purification Kit, eluted with 10 mM Tris-HCl, pH 8.5, and quantified by 1K Chip on a LabChip GX instrument (Caliper Life Sciences) and combined into separate equimolar pools for the catalytically active and empty vector control samples. PCR products were not obtained for 3 CCR5 sites and 7 VF2468 sites, which excluded these samples from further analysis. Multiplexed Illumina library preparation was performed according to the manufacturer's specifications, except that AMPure XP beads (Agencourt) were used for purification following adapter ligation and PCR enrichment steps. Illumina indices 11 ("GGCTAC") and 12 ("CTTGTA") were used for ZFN-treated libraries while indices 4 ("TGACCA") and 6 ("GCCAAT") were used for the empty vector controls. Library concentrations were quantified by KAPA Library Quantification Kit for Illumina Genome Analyzer Platform (Kapa Biosystems). Equal amounts of the barcoded libraries derived from active- and empty vector-treated cells were diluted to 10 nM and subjected to single read sequencing on an Illumina HiSeq 2000 at the Harvard University FAS Center for Systems Biology Core facility. Sequences were analyzed using Protocol 9 for active ZFN samples and empty vector controls.

Statistical Analysis.

In FIG. 8, P-values were calculated for a one-sided test of the difference in the means of the number of target site mutations in all possible pairwise comparisons among pre-selection, 0.5 nM post-selection, 1 nM post-selection, 2 nM post-selection, and 4 nM post-selection libraries for CCR5-224 or VF2468. The t-statistic was calculated as $t=(x\_bar_1-x\_bar_2)/sqrt(1\times p\_hat_1\times(1-p\_hat_1)/n_1+1\times p\_hat_2\times(1-p\_hat_2)/n_1)$, where $x\_bar_1$ and $x\_bar_2$ are the means of the distributions being compared, l is the target site length (24 for CCR5-224; 18 for VF2468), $p\_hat_1$ and $p\_hat_2$ are the calculated probabilities of mutation (x_bar/l) for each library, and $n_1$ and $n_2$ are the total number of sequences analyzed for each selection (Table 2). All pre- and post-selection libraries were assumed to be binomially distributed.

In Tables 4 and 7, P-values were calculated for a one-sided test of the difference in the proportions of sequences with insertions or deletions from the active ZFN sample and the empty vector control samples. The t-statistic was calculated as $t=(p\_hat_1-p\_hat_2)/sqrt((p\_hat_1\times(1-p\_hat_1)/n_1)+(p\_hat_2\times(1-p\_hat_2)/n_2))$, where $p\_hat_1$ and $n_1$ are the proportion and total number, respectively, of sequences from the active sample and $p\_hat_2$ and $n_2$ are the proportion and total number, respectively, of sequences from the empty vector control sample.

Plots.

All heat maps were generated in the R software package with the following command: image([variable], zlim=c(−1, 1), col=colorRampPalette(c("red","white","blue"), space="Lab")(2500)

Protocol 1: Quality Score Filtering and Sequence Binning.

1) search each position of both pairs of sequencing read for quality score, reject if any position has quality score='B'
2) output to separate files all sequence reads where the first sequence in the pair start with barcodes ("AAT", "ATA", "TAA", "CAC", "TCG") and count the number of sequences corresponding to each barcode Protocol 2: Filtering by ZFN ("AAT", "ATA", "TAA", "CAC")

For each binned file,
1) accept only sequence pairs where both sequences in the pair start with the same barcode
2) identify orientation of sequence read by searching for constant regions
   orientation 1 is identified by the constant region "CGATCGTTGG" (SEQ ID NO:127)
   orientation 2 is identified by the constant region "CAGTGGAACG" (SEQ ID NO:128)
3) search sequences from position 4 (after the barcode) up to the first position in the constant region for the subsequence that has the fewest mutations compared to the CCR5-224 and VF2468 half site that corresponds to the identified constant region
   search sequences with orientation 1 for "GATGAGGATGAC" (SEQ ID NO:129) (CCR5-224(+)) and "GACGCTGCT" (SEQ ID NO:130) (VF2468(−))
   search sequences with orientation 2 for "AAACTGCAAAAG" (SEQ ID NO:131) (CCR5-224(−)) and "GAGTGAGGA" (SEQ ID NO:132) (VF2468(+))
4) bin sequences as CCR5-224 or VF2468 by testing for the fewest mutations across both half-sites
5) the positions of the half-sites and constant sequences are used to determine the overhang/spacer sequences, the flanking nucleotide sequences, and the tag sequences
   the subsequence between the half-site of orientation 1 and the constant region is the tag sequence
   if there is no tag sequence, the tag sequence is denoted by 'X'
   the overhang sequence is determined by searching for the longest reverse-complementary subsequences between the subsequences of orientation 1 and orientation 2 that start after the barcodes
   the spacer sequence is determined by concatenating the reverse complement of the subsequence in orientation 1 that is between the overhang and the half-site (if any), the overhang, and the subsequence in orientation 2 that is between the overhang and the halfsite
   if there is overlap between the overhang and half-site, only the non-overlapping subsequence present in the overhang is counted as part of the spacer 6) to remove duplicate sequences, sort each sequence pair into a tree each level of the tree corresponds to a position in the sequence each node at each level corresponds to a particular base (A, C, G, T, or X=not(A, C, G, or T)) and points to the base of the next position (A, C, G, T, X)

the sequence pairs are encoded in the nodes and a subsequence consisting of the concatenation of the spacer sequence, flanking nucleotide sequence, and tag sequence is sorted in the tree at the terminal nodes of the tree, each newly entered sequence is compared to all other sequences in the node to avoid duplication 7) the contents of the tree are recursively outputted into separate files based on barcode and ZFN Protocol 3: Library Filtering ("TCG")

1) accept only sequence pairs where both sequences in the pair start with the same barcode 2) analyze the sequence pair that does not contain the sequence "TCGTTGGGAACCGGAGCTGAATGAAGC-CATACCAAACGAC" (SEQ ID NO:133) (the other pair contains the library sequence)

3) search sequences for ZFN half-sites and bin by the ZFN site that has fewer mutations search for "GTCATCCTCATC" (SEQ ID NO:134) and "AAACTGCAAAAG" (SEQ ID NO:135) (CCR5-224) and "AGCAGCGTC" (SEQ ID NO:136) and "GAGTGAGGA" (SEQ ID NO:137) (VF2468)

4) identify the spacer, flanking nucleotide, and nucleotide tag sequences based on the locations of the half-sites 5) use the tree algorithm in step 6 under Filtering by ZFN to eliminate duplicate sequences Protocol 4: Sequence Profiles 1) analyze only sequences that contain no 'N' positions and have spacer lengths between 4 and 7

2) tabulate the total number of mutations, the spacer length, the overhang length, the nucleotide frequencies for the (+) and (−) half-sites, the nucleotide frequencies for spacers that are 4-bp, 5-bp, 6-bp, and 7-bp long, and the nucleotide frequencies for the flanking nucleotide and the tag sequence 3) repeat steps 1 and 2 for library sequences 4) calculate specificity scores at each position using positive specificity score=(frequency of base pair at position[post-selection]−frequency of base pair at position[pre-selection])/(1−frequency of base pair at position[pre-selection]) negative specificity score=(frequency of base pair at position[post-selection]−frequency of base pair at position[pre-selection])/(frequency of base pair at position[pre-selection])

Protocol 5: Genomic Matches 1) the human genome sequence was searched with 24 and 25 base windows (CCR5-224) and 18 and 19 base windows (VF2468) for all sites within nine mutations (CCR5-224) or six mutations (VF2468) of the canonical target site with all spacer sequences of five or six bases being accepted 2) each post-selection sequence was compared to the set of genomic sequences within nine and six mutations of CCR5-224 and VF2468, respectively Protocol 6: Enrichment Factors for Sequences with 0, 1, 2, or 3 Mutations 1) for each sequence, divide the frequency of occurrence in the post-selection library by the frequency of occurrence in the pre-selection library Protocol 7: Filtered Sequence Profiles 1) use the algorithm described above in Sequence profiles, except in addition, only analyze sequences with off-target bases at given positions for both pre- and post-selection data Protocol 8: Compensation Difference Map 1) use Filtered sequence profiles algorithm for mutation at every position in both half-sites 2) calculate Δ(specificity score)=filtered specificity score−non-filtered specificity score Protocol 9: NHEJ Search 1) identify the site by searching for exact flanking sequences 2) count the number of inserted or deleted bases by comparing the length of the calculated site to the length of the expected site and by searching for similarity to the unmodified target site (sequences with 5 or fewer mutations compared to the intended site were counted as unmodified)

3) inspect all sites other than CCR5, CCR2, and VEGF-A promoter by hand to identify true insertions or deletions

REFERENCES

1. Kim, Y. G., Cha, J. & Chandrasegaran, S. Hybrid restriction enzymes: zinc finger fusions to Fok I cleavage domain. Proc Natl Acad Sci USA 93, 1156-60 (1996).
2. Vanamee, E. S., Santagata, S. & Aggarwal, A. K. FokI requires two specific DNA sites for cleavage. J Mol Biol 309, 69-78 (2001).
3. Hockemeyer, D. et al. Efficient targeting of expressed and silent genes in human ESCs and iPSCs using zinc-finger nucleases. Nat Biotechnol 27, 851-7 (2009).
4. Maeder, M. L. et al. Rapid "open-source" engineering of customized zinc-finger nucleases for highly efficient gene modification. Mol Cell 31, 294-301 (2008).
5. Zou, J. et al. Gene targeting of a disease-related gene in human induced pluripotent stem and embryonic stem cells. Cell Stem Cell 5, 97-110 (2009).
6. Perez, E. E. et al. Establishment of HIV-1 resistance in CD4+ T cells by genome editing using zinc-finger nucleases. Nat Biotechnol 26, 808-16 (2008).
7. Urnov, F. D. et al. Highly efficient endogenous human gene correction using designed zinc-finger nucleases. Nature 435, 646-51 (2005).
8. Santiago, Y. et al. Targeted gene knockout in mammalian cells by using engineered zinc-finger nucleases. Proc Natl Acad Sci USA 105, 5809-14 (2008).
9. Cui, X. et al. Targeted integration in rat and mouse embryos with zinc-finger nucleases. Nat Biotechnol 29, 64-7 (2011).
10. Cornu, T. I. et al. DNA-binding specificity is a major determinant of the activity and toxicity of zinc-finger nucleases. Mol Ther 16, 352-8 (2008).
11. Segal, D. J., Dreier, B., Beerli, R. R. & Barbas, C. F., 3rd. Toward controlling gene expression at will: selection and design of zinc finger domains recognizing each of the 5'-GNN-3' DNA target sequences. Proc Natl Acad Sci USA 96, 2758-63 (1999).
12. Bulyk, M. L., Huang, X., Choo, Y. & Church, G. M. Exploring the DNA-binding specificities of zinc fingers with DNA microarrays. Proc Natl Acad Sci USA 98, 7158-63 (2001).
13. Meng, X., Thibodeau-Beganny, S., Jiang, T., Joung, J. K. & Wolfe, S. A. Profiling the DNA-binding specificities of engineered Cys2His2 zinc finger domains using a rapid cell-based method. Nucleic Acids Res 35, e81 (2007).

14. Wolfe, S. A., Greisman, H. A., Ramm, E. I. & Pabo, C. O. Analysis of zinc fingers optimized via phage display: evaluating the utility of a recognition code. J Mol Biol 285, 1917-34 (1999).
15. Segal, D. J. et al. Evaluation of a modular strategy for the construction of novel polydactyl zinc finger DNA-binding proteins. Biochemistry 42, 2137-48 (2003).
16. Zykovich, A., Korf, I. & Segal, D. J. Bind-n-Seq: high-throughput analysis of in vitro protein-DNA interactions using massively parallel sequencing. Nucleic Acids Res 37, e151 (2009).
17. Yanover, C. & Bradley, P. Extensive protein and DNA backbone sampling improves structure-based specificity prediction for C2H2 zinc fingers. Nucleic Acids Res (2011).
18. Beumer, K., Bhattacharyya, G., Bibikova, M., Trautman, J. K. & Carroll, D. Efficient gene targeting in Drosophila with zinc-finger nucleases. Genetics 172, 2391-403 (2006).
19. Bibikova, M., Golic, M., Golic, K. G. & Carroll, D. Targeted chromosomal cleavage and mutagenesis in Drosophila using zinc-finger nucleases. Genetics 161, 1169-75 (2002).
20. Gupta, A., Meng, X., Zhu, L. J., Lawson, N. D. & Wolfe, S. A. Zinc finger protein-dependent and -independent contributions to the in vivo off-target activity of zinc finger nucleases. Nucleic Acids Res 39, 381-92 (2011).
21. Chen, J. et al. Molecular cloning and characterization of a novel human BTB domain-containing gene, BTBD10, which is down-regulated in glioma. Gene 340, 61-9 (2004).
22. Wang, X. et al. Glucose metabolism-related protein 1 (GMRP1) regulates pancreatic beta cell proliferation and apoptosis via activation of Akt signalling pathway in rats and mice. Diabetologia 54, 852-63 (2011).
23. Nawa, M., Kanekura, K., Hashimoto, Y., Aiso, S. & Matsuoka, M. A novel Akt/PKB-interacting protein promotes cell adhesion and inhibits familial amyotrophic lateral sclerosis-linked mutant SOD1-induced neuronal death via inhibition of PP2A-mediated dephosphorylation of Akt/PKB. Cell Signal 20, 493-505 (2008).
24. Petek, L. M., Russell, D. W. & Miller, D. G. Frequent endonuclease cleavage at off-target locations in vivo. Mol Ther 18, 983-6 (2010).
25. Hurt, J. A., Thibodeau, S. A., Hirsh, A. S., Pabo, C. O. & Joung, J. K. Highly specific zinc finger proteins obtained by directed domain shuffling and cell-based selection. Proc Natl Acad Sci USA 100, 12271-6 (2003).
26. Ramirez, C. L. et al. Unexpected failure rates for modular assembly of engineered zinc fingers. Nat Methods 5, 374-5 (2008).
27. Shimizu, Y. et al. Adding Fingers to an Engineered Zinc Finger Nuclease Can Reduce Activity. Biochemistry 50, 5033-41 (2011).
28. Bibikova, M. et al. Stimulation of homologous recombination through targeted cleavage by chimeric nucleases. Mol Cell Biol 21, 289-97 (2001).
29. Handel, E. M., Alwin, S. & Cathomen, T. Expanding or restricting the target site repertoire of zinc-finger nucleases: the inter-domain linker as a major determinant of target site selectivity. Mol Ther 17, 104-11 (2009).
30. Miller, J. C. et al. An improved zinc-finger nuclease architecture for highly specific genome editing. Nat Biotechnol 25, 778-85 (2007).
31. Cradick, T. J., Keck, K., Bradshaw, S., Jamieson, A. C. & McCaffrey, A. P. Zinc-finger nucleases as a novel therapeutic strategy for targeting hepatitis B virus DNAs. Mol Ther 18, 947-54 (2010).
32. Doyon, Y. et al. Heritable targeted gene disruption in zebrafish using designed zinc-finger nucleases. Nat Biotechnol 26, 702-8 (2008).
33. Rozen, S. & Skaletsky, H. Primer3 on the WWW for general users and for biologist programmers. Methods Mol Biol 132, 365-86 (2000).

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

Example 2—TALENs

The site preferences of different TALENs were profiled in analogy to the work done for ZFN profiling described above. The experiments and results are described in FIGS. 19-49. Selection 1 included a comparison between TALENs having a +28 vs. a +63 linker. Selection 2 included a comparison of TALENs of different TAL domain length.

TAL DNA binding domains are the basis of a transformative technology to specifically modulate target DNA both in vitro and in cells. The designable TAL DNA binding domains have advantages in targetable sequence space and ease of construction compared to other DNA binding domains, for example, zinc fingers. These TAL DNA binding domains are comprised of repeats of a 34 amino acid domain with a highly variable di-amino acid (RVD) coding for recognition of a single base pair in the target DNA sequence (FIG. 20). Based on the robustness of this RVD code and the crystal structure of a TAL bound to its DNA target, it is likely that binding of a single repeat to a base pair is relatively independent of adjacent repeat binding. The TAL DNA binding domain (an array of repeats) can be linked to the monomer of a heterodimeric nuclease domain to form a TAL nuclease. Thus, two distinct TAL nucleases can bind adjacent target half sites to cleave a specific sequence resulting in genome modifications in vivo (FIGS. 19 and 20). While a number of studies have investigated the specificity of TAL DNA binding, to our knowledge no studies have profiled the specificity of TAL nucleases on a large scale. We applied the concept of high-throughput, in vitro selection for nuclease specificity outlined for ZFNs in Example 1 to TAL nucleases to both confirm the modular, independent binding of TAL repeats expected from their easy design-ability and also identify genomic off-target sequences cut by therapeutically relevant TAL nucleases.

The selection scheme for profiling the specificity of TAL nucleases via in vitro library screening was in analogy to the selection scheme described for ZFNs in Example. Detailed protocols are provided below:

Preparation of Library of Partly Randomized Target Sites
2 ul of 10 pmol TALNCCR5 Library Oligo (separate reactions for each oligo)
2 ul 10× CircLigase II 10× Reaction Buffer
1 ul 50 mM $MnCl_2$
1 ul CircLigase II ssDNA Ligase (100 U) [Epicentre]
X ul water to 20 uL total volume
Incubate 16 hrs at 60° C. Incubate 10 min at 85° C. to inactivate.
Add 2.5 ul of each Circligase II reaction (without purification)
Add 25 ul TempliPhi™ [GE Healthcare] 100 sample buffer.

Incubate 3 min at 95° C. Slow cool to 4° C.
Add 25 ul TempliPhi™ reaction buffer/1 ul enzyme mix.
Incubate 16 hrs at 30° C. Heat inactive 10 min at 55° C.
Quantify amount of dsDNA using Quant-iT™ PicoGreen® dsDNA [Invitrogen]
Combine equal moles of TempliPhi™ reactions to final 2 uM with respect to number of cut sites.

TALN Expression
16 ul TnT® Quick Coupled [Promega]
0.4 ul 1 mM methionine
2 uL of 0.8 ug TALN vector expression plasmid or water for empty lysate
1.6 uL of water
Incubate at 30 for 1.5 hours and then store at 4° C. overnight.
Quantify amount of TALN in lysate via Western Blot.

TALN Digestion
25 uL of 10×NEB Buffer 3 [New England Biolabs]
10 uL of 2 uM TempliPh Library DNA
165 uL water
Add left TALN lysate to 20 nM total left TALN
Add right TALN lysate to 20 nM total right TALN
Add empty lysate to total of 50 uL lysate
Incubate 2 hrs at 37° C. Add 5 ul (50 ug) RNaseA (Qiagen).
Incubate 10 min at RT. Purify with Qiagen PCR Purification Kit. Elute in 50 uL of 1 mM Tris, pH 8.0.

Adapter Ligation, PCR and Gel Purification of TALN Digestion
50 ul digested DNA
3 ul dNTP mix
6 ul NEB 2
1 ul Klenow [New England Biolabs]
Incubate 30 min at RT. Purify with Qiagen PCR Purification Kit.
50 ul eluted DNA
5.9 ul T4 DNA Ligase Buffer (NEB)
2 ul (20 pmol) heat/cooled adapter (different adapter for each selection)
1 ul T4 DNA ligase (NEB, 400 units)
Incubate at RT for 20 hrs. Purify with Qiagen PCR Purification Kit.
6 uL of TALN digested DNA
30 uL of 5× Buffer HF
1.5 uL 100 uM Illumina_fwd Primer
1.5 uL 100 uM PE_TALN_rev1 Primer
3 uL 10 mM dNTP
1.5 uL Phusion Hot Start II
106.5 uL of water
98° C. for 3 min, do 15 cycles of 98° C. for 15 s, 60° C. for 15 s, 72° C. for 1 min. Purify with Qiagen PCR Purification Kit
Gel Purify on 2% Agarose gel loading 1 ug of eluted DNA in 40 uL of 10% glycerol. Run on gel at 135V for 35 min. Gel purify bands of the length corresponding to a cut half site+full half site+adapter with filter paper. Remove filter paper and collect supernatant. Purify with Qiagen PCR Purification Kit.
6 uL of TALN digested DNA (5-26-12)
30 uL of 5× Buffer HF
1.5 uL 100 uM Illumina_fwd Primer
1.5 uL 100 uM PE_TALN_rev2 Primer
3 uL 10 mM dNTP
1.5 uL Phusion Hot Start II
106.5 uL of water
98° C. for 3 min, do 6 cycles of 98° C. for 15 s, 60° C. for 15 s, 72° C. for 1 min. Purify with Qiagen PCR Purification Kit.

Preparation of Pre-Selection Library
25 uL of 10×NEB Buffer 4
10 uL of 2 uM TempliPhi Library DNA
165 uL water
5 uL of Appropriate Restriction Enzyme [New England Biolabs]
210 uL of water
Incubate 1 hrs at 37° C. Purify with Qiagen PCR Purification Kit.
50 ul eluted DNA
5.9 ul T4 DNA Ligase Buffer (NEB)
2 ul (20 pmol) heat/cooled adapter (pool of 4 adapter sequences)
1 ul T4 DNA ligase (NEB, 400 units)
Incubate at RT for 20 hrs. Purify with Qiagen PCR Purification Kit.
6 uL of Restriction Enzyme Digested DNA (5-26-12)
30 uL of 5× Buffer HF
1.5 uL 100 uM Illumina_rev Primer
1.5 uL 100 uM TALNLibPCR Primer
3 uL 10 mM dNTP
1.5 uL Phusion Hot Start II
106.5 uL of water
98° C. for 3 min, 12 cycles of 98° C. for 15 s, 60° C. for 15 s, 72° C. for 1 min. Purify with Qiagen PCR Purification Kit High-Throughput Sequencing
Quantify via RT-qPCR
12.5 uL of IQ SYBR Green Supermix
1 uL of 10 uM Illumina_rev
1 uL of 10 uM Illumina_fwd
9.5 uL of water
1 uL of DNA template (both Pre-Selection Library and TALN Digestion)
95° C. for 5 min, do 30 cycles of 95° C. for 30 s, 65° C. for 30 s, 72° C. for 40 s.
Dilute DNA to 2 nM (compared to sequencing standard)
5 uL of TALN Digestion 2 nM DNA
2.5 uL of Pre-Selection Library 2 nM DNA
10 uL of 0.1N NaOH
Incubate at room temp for 5 min
Sequence via Illumina Mi-Seq Computational Filtering
For TALN Digested sequences, find two appropriately spaced constant oligo sequences
For Pre-selection Library sequences, find appropriately spaced constant oligo sequence and library adapter sequence
Parse sequence into cut overhang, left half site, spacer, right half site
Remove sequences with poor Illumina base scores in half sites (<B=rejected)

Primer Sequences

| Primer | Sequence |
|---|---|
| J61TALCCR5B_10 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 138 and 139) |

| Primer | Sequence |
|---|---|
| J63TALCCR5B_12 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 140 and 141) |
| J65TALCCR5B_14 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 142 and 143) |
| J66TALCCR5B_15 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 144 and 145) |
| J67TALCCR5B_16 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 146 and 147) |
| J68TALCCR5B_17 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 148 and 149) |
| J69TALCCR5B_18 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 150 and 151) |
| J71TALCCR5B_20 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 152 and 153) |
| J73TALCCR5B_22 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 154 and 155) |
| J75TALCCR5B_24 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 156 and 157) |
| CGTAAadapterfwd | AATGATACGGCGACCACCGAGATCTACACTCTTTCCCTACACGACGCTCTTCCGATCTCGTAA (SEQ ID NO: 158) |
| CGTAAadapterREV | TTACGAGATCGGAAGAGCGTCGTGTAGGGAAAGAGTGTAGATCTCGGTGG (SEQ ID NO: 159) |
| GTACTadapterfwd | AATGATACGGCGACCACCGAGATCTACACTCTFTCCCTACACGACGCTCTTCCGATCTGTACT (SEQ ID NO: 160) |
| GTACTadapterREV | AGTACAGATCGGAAGAGCGTCGTGTAGGGAAAGAGTGTAGATCTCGGTGG (SEQ ID NO: 161) |
| TACGAadapterfwd | AATGATACGGCGACCACCGAGATCTACACTCTTTCCCTACACGACGCTCTTCCGATCTTACGA (SEQ ID NO: 162) |
| TACGAadapterREV | TCGTAAGATCGGAAGAGCGTCGTGTAGGGAAAGAGTGTAGATCTCGGTGG (SEQ ID NO: 163) |
| ATGCTadapterfwd | AATGATACGGCGACCACCGAGATCTACACTCTTTCCCTACACGACGCTCTTCCGATCTATGCT (SEQ ID NO: 164) |
| ATGCTadapterREV | AGCATAGATCGGAAGAGCGTCGTGTAGGGAAAGAGTGTAGATCTCGGTGG (SEQ ID NO: 165) |
| TGCAAadapterfwd | AATGATACGGCGACCACCGAGATCTACACTCTTTCCCTACACGACGCTCTTCCGATCTTGCAA (SEQ ID NO: 166) |
| TGCAAadapterREV | TTGCAAGATCGGAAGAGCGTCGTGTAGGGAAAGAGTGTAGATCTCGGTGG (SEQ ID NO: 167) |
| GCATTadapterfwd | AATGATACGGCGACCACCGAGATCTACACTCTTTCCCTACACGACGCTCTTCCGATCTGCATT (SEQ ID NO: 168) |

| Primer | Sequence |
| --- | --- |
| GCATTadapterREV | AATGCAGATCGGAAGAGCGTCGTGTAGGGAAAGAGTGTAGATCTCG GTGG (SEQ ID NO: 169) |
| GACTAadapterfwd | AATGATACGGCGACCACCGAGATCTACACTCTTTCCCTACACGACG CTCTTCCGATCTGACTA (SEQ ID NO: 170) |
| GACTAadapterREV | TAGTCAGATCGGAAGAGCGTCGTGTAGGGAAAGAGTGTAGATCTCG GTGG (SEQ ID NO: 171) |
| ACTGTadapterfwd | AATGATACGGCGACCACCGAGATCTACACTCTTTCCCTACACGACG CTCTTCCGATCTACTGT (SEQ ID NO: 172) |
| ACTGTadapterREV | ACAGTAGATCGGAAGAGCGTCGTGTAGGGAAAGAGTGTAGATCTCG GTGG (SEQ ID NO: 173) |
| CTGAAadapterfwd | AATGATACGGCGACCACCGAGATCTACACTCTTTCCCTACACGACG CTCTTCCGATCTCTGAA (SEQ ID NO: 174) |
| CTGAAadapterREV | TTCAGAGATCGGAAGAGCGTCGTGTAGGGAAAGAGTGTAGATCTCG GTGG (SEQ ID NO: 175) |
| PE_TALCCR5B_rev1 | CAAGCAGAAGACGGCATACGAGATCGTGATGTGACTGGAGTTCAGA CGTGTGCTCTTCCG (SEQ ID NO: 176) |
| PE_TALCCR5B_rev2 | CAGACGTGTGCTCTTCCGATCNNNNAGCGTGGAGTCCCGAGG (SEQ ID NO: 177) |
| PE_TALCCR5B_rev | CAAGCAGAAGACGGCATACGAGATACAGTCGTGACTGGAGTTCAGA CGTGTGCTCTTCCGATCNNNNAGCGTGGAGTCCCGAGG (SEQ ID NO: 178) |
| PE_TALCCR5Blib adapter1 | TCGGGAACGTGATCGGAAGAGCACACGTCTGAACTCCAGTCACCGT CTAATCTCGTATGCCGTCTTCTGCTTG (SEQ ID NO: 179) |
| PE_TALCCR5Blib adapterrev1 | GTGACTGGAGTTCAGACGTGTGCTCTTCCGATCACGTT (SEQ ID NO: 180) |
| PE_TALCCR5Blib adapter2 | TCGGGACGTAGATCGGAAGAGCACACGTCTGAACTCCAGTCACCGT CTAATCTCGTATGCCGTCTTCTGCTTG (SEQ ID NO: 181) |
| PE_TALCCR5Blib adapterrev2 | GTGACTGGAGTTCAGACGTGTGCTCTTCCGATCTACGT (SEQ ID NO: 182) |
| PE_TALCCR5Blib adapter3 | TCGGGAGTACGATCGGAAGAGCACACGTCTGAACTCCAGTCACCGT CTAATCTCGTATGCCGTCTTCTGCTTG (SEQ ID NO: 183) |
| PE_TALCCR5Blib adapterrev3 | GTGACTGGAGTTCAGACGTGTGCTCTTCCGATCGTACT (SEQ ID NO: 184) |
| PE_TALCCR5Blib adapter4 | TCGGGATACGGATCGGAAGAGCACACGTCTGAACTCCAGTCACCGT CTAATCTCGTATGCCGTCTTCTGCTTG (SEQ ID NO: 185) |
| PE_TALCCR5Blib adapterrev4 | GTGACTGGAGTTCAGACGTGTGCTCTTCCGATCCGTAT (SEQ ID NO: 186) |
| TALCCR5BlibPCR | AATGATACGGCGACCACCGAGATCTACACTCTTTCCCTACACGACG CTCTTCCGATCTNNNNCCTCGGGACTCCACGCT (SEQ ID NO: 187) |
| IlluminaFwd | AATGATACGGCGACCAC (SEQ ID NO: 188) |
| IlluminaRev | CAAGCAGAAGACGGCATACGA (SEQ ID NO: 189) |

CONCLUSIONS

The relatively regular (log relationship) trend between number of half sites mutations and enrichment is consistent with a single TAL repeat binding a base pair independent of other repeat binding. A single mutation in the cleavage site does not significantly alter the distribution of other mutations in the compensation difference analysis suggesting that the TAL repeat domains bind independently. The +28 linker is more specific than the +63 linker TALN constructs. While TALNs recognizing larger target sites are less specific in that they can tolerate more mutations, the abundance of the mutant larger sequences is less than the increase in enrichment, thus the in vitro selection data and abundance of off-target sites indicates off-target cleavage to be significantly less likely in longer TALN pairs. Combining the regular decrease of cleavage efficiency (enrichment) as total target site mutations increase and the enrichment at each position it is possible to predict the off-target site cleavage of any sequence. For the most part, in the TALN selection the enrichment was dependent on the total mutations in both half sites and not on the distribution of mutations between half sites as was observed for zinc finger nucleases (ZFN). This observation combined with the context dependent binding of ZFNs indicated that TALENs may readily be engineered to a specificity as high or higher than their ZFN equivalents.

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

EQUIVALENTS AND SCOPE

Those skilled in the art will recognize, or be able to ascertain using no more than routine experimentation, many equivalents to the specific embodiments of the invention described herein. The scope of the present invention is not intended to be limited to the above description, but rather is as set forth in the appended claims.

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process.

Furthermore, it is to be understood that the invention encompasses all variations, combinations, and permutations in which one or more limitations, elements, clauses, descriptive terms, etc., from one or more of the claims or from relevant portions of the description is introduced into another claim. For example, any claim that is dependent on another claim can be modified to include one or more limitations found in any other claim that is dependent on the same base claim. Furthermore, where the claims recite a composition, it is to be understood that methods of using the composition for any of the purposes disclosed herein are included, and methods of making the composition according to any of the methods of making disclosed herein or other methods known in the art are included, unless otherwise indicated or unless it would be evident to one of ordinary skill in the art that a contradiction or inconsistency would arise.

Where elements are presented as lists, e.g., in Markush group format, it is to be understood that each subgroup of the elements is also disclosed, and any element(s) can be removed from the group. It is also noted that the term "comprising" is intended to be open and permits the inclusion of additional elements or steps. It should be understood that, in general, where the invention, or aspects of the invention, is/are referred to as comprising particular elements, features, steps, etc., certain embodiments of the invention or aspects of the invention consist, or consist essentially of, such elements, features, steps, etc. For purposes of simplicity those embodiments have not been specifically set forth in haec verba herein. Thus for each embodiment of the invention that comprises one or more elements, features, steps, etc., the invention also provides embodiments that consist or consist essentially of those elements, features, steps, etc.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in different embodiments of the invention, to the tenth of the unit of the lower limit of the range, unless the context clearly dictates otherwise. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

TABLE 1

CCR5-224 off-target sites in the genome of human K562 cells. Lower case letters indicate mutations compared to the target site. Sites marked with an 'X' were found in the corresponding in vitro selection dataset. 'T' refers to the total number of mutations in the site, and '(+)' and '(−)' to the number of mutations in the (+) and (−) half-sites, respectively. The sequences of the sites are listed as 5' (+) half-site/spacer/(−) half-site 3', therefore the (+) half-site is listed in the reverse sense as it is in the sequence profiles. K562 modification frequency is the frequency of observed sequences showing significant evidence of non-homologous end joining repair (see Methods) in cells expressing active ZFN compared to cells expressing empty vector. Sites that did not show statistically significant evidence of modifications are listed as not detected (n.d.), and K562 modification frequency is left blank for the three sites that were not analyzed due to non-specific PCR amplification from the genome. Table 4 shows the sequence counts and P-values for the tested sites used to determine K562 modification frequency, and Table 6 shows the modified sequences obtained for each site.

| mutations T | (+) | (−) | gene | (+) half-site (SEQ ID NOs: 190-226) | spacer | (−) half-site (SEQ ID NOs: 227-263) | in vitro selection stringency (nM) 4 | 2 | 1 | 0.5 | K562 modification frequency |
|---|---|---|---|---|---|---|---|---|---|---|---|
| | | | | Full Sequence (SEQ ID NOs: 264-300) | | | | | | | |
| 0 | 0 | 0 | CCR5 (coding) | GTCATCCTCATC | CTGAT | AAACTGCAAAAG | X | X | X | X | 1:2.3 |
| 2 | 1 | 1 | CCR2 (coding) | GTCgTCCTCATC | TTAAT | AAACTGCAAAAa | X | X | X | X | 1:10 |
| 3 | 2 | 1 | BTBD10 (promoter) | GTttTCCTCATC | AAAGC | AAACTGCAAAAt | X | X | | | 1:1,400 |
| 4 | 0 | 4 | | GTCATCCTCATC | AGAGA | AAACTGgctAAt | X | X | | | n.d. |
| 4 | 3 | 1 | SLC4A8 | taaATCCTCATC | TCTATA | AAAtGCAAAAG | X | X | | | n.d. |
| 3 | 2 | 1 | Z83955 RNA | GTCATCCcaATC | GAAGAA | AAACTGaAAAAG | X | | X | | n.d. |
| 3 | 1 | 2 | DGKK | cTCATCCTCATC | CATGC | AcAaTGCAAAAG | X | | | | n.d. |
| 3 | 1 | 2 | GALNT13 | GTCATCCTCAgC | ATGGG | AAACaGCAgAAG | X | | | | n.d. |
| 3 | 1 | 2 | | GTCATCtTCATC | AAAAG | gAACTGCAAAAc | X | | | | 1:2,800 |
| 4 | 0 | 4 | | GTCATCCTCATC | CAATA | AAAgaaCAAAgG | X | | | | n.d. |
| 4 | 1 | 3 | TACR3 | GTCATCtTCATC | AGCAT | AAACTGtAAAgt | X | | | | 1:300 |
| 4 | 1 | 3 | PIWIL2 | GTCATCCTCATa | CATAA | AAACTGCcttAG | X | | | | |
| 4 | 1 | 3 | | aTCATCCTCATC | CATCC | AAtgTtCAAAAG | X | | | | n.d. |
| 4 | 3 | 1 | | GTCcTgCTCAgC | AAAAG | AAACTGaAAAAG | X | | | | 1:4,000 |
| 4 | 3 | 1 | KCNB2 | aTgtTCCTCATC | TCCCG | AAACTGCAAAtG | X | | | | 1:1,400 |
| 4 | 3 | 1 | | GTCtTCCTgATg | CTACC | AAACTGgAAAAG | X | | | | 1:5,300 |
| 4 | 3 | 1 | | aaCATCCaCATC | ATGAA | AAACTGCAAAAa | X | | | | n.d. |
| 6 | 3 | 3 | | aTCtTCCTCATt | ACAGG | AAAaTGtAAtAG | X | | | | n.d. |
| 6 | 4 | 2 | CUBN | GgCtTCCTgAcC | CACGG | AAACTGtAAAtG | X | | | | |
| 6 | 5 | 1 | NID1 | GTttTgCaCATt | TCAAT | tAACTGCAAAAG | X | | | | n.d. |
| 3 | 2 | 1 | | GTCAaCCTCAaC | ACCTAC | AgACTGCAAAAG | X | | | | 1:1,700 |
| 4 | 1 | 3 | WWOX | GTCATCCTCcTC | CAACTC | cAAtTGCtAAAG | X | | | | n.d. |
| 4 | 2 | 2 | AMBRA1 | GTCtTCCTCcTC | TGCACA | tcACTGCAAAAG | X | | | | n.d. |
| 4 | 2 | 2 | | GTgATaCTCATC | ATCAGC | AAtCTGCAtAAG | X | | | | n.d. |
| 4 | 2 | 2 | WBSCR17 | GTtATCCTCAgC | AAACTA | AAACTGgAAcAG | X | | | | 1:860 |

TABLE 1-continued

CCR5-224 off-target sites in the genome of human K562 cells. Lower case letters indicate mutations compared to the target site. Sites marked with an 'X' were found in the corresponding in vitro selection dataset. 'T' refers to the total number of mutations in the site, and '(+)' and '(−)' to the number of mutations in the (+) and (−) half-sites, respectively. The sequences of the sites are listed as 5' (+) half-site/spacer/(−) half-site 3', therefore the (+) half-site is listed in the reverse sense as it is in the sequence profiles. K562 modification frequency is the frequency of observed sequences showing significant evidence of non-homologous end joining repair (see Methods) in cells expressing active ZFN compared to cells expressing empty vector. Sites that did not show statistically significant evidence of modifications are listed as not detected (n.d.), and K562 modification frequency is left blank for the three sites that were not analyzed due to non-specific PCR amplification from the genome. Table 4 shows the sequence counts and P-values for the tested sites used to determine K562 modification frequency, and Table 6 shows the modified sequences obtained for each site.

| mutations | | | | (+) half-site (SEQ ID NOs: | (−) half-site SEQ ID NOs: | in vitro selection stringency (nM) | | | | K562 modification |
|---|---|---|---|---|---|---|---|---|---|---|
| T | (+) | (−) | gene | 190-226) | spacer 227-263) | 4 | 2 | 1 | 0.5 | frequency |
| 4 | 2 | 2 | ITSN | cTCATgCTCATC | ATTTGT tAACTGCAAAAt | X | | | | n.d. |
| 4 | 4 | 0 | | GcCAgtCTCAgC | ATGGTG AAACTGCAAAAG | X | | | | n.d. |
| 4 | 4 | 0 | | cTCATtCTgtTC | ATGAAA AAACTGCAAAAG | X | | | | n.d. |
| 5 | 3 | 2 | | GaagTCCTCATC | CCGAAG AAACTGaAAgAG | X | | | | n.d. |
| 5 | 3 | 2 | ZNF462 | GTCtTCCTCtTt | CACATA AAACcGCAAAtG | X | | | | n.d. |
| 5 | 4 | 1 | | aTaATCCTttTC | TGTTTA AAACaGCAAAAG | X | | | | n.d. |
| 5 | 4 | 1 | | GaCATCCaaATt | ACATGG AAACTGaAAAAG | X | | | | n.d. |
| 5 | 5 | 0 | SDK1 | GTCtTgCTgtTg | CACCTC AAACTGCAAAAG | X | | | | n.d. |
| 4 | 1 | 3 | SPTB (coding) | GTCATCCgCATC | GCCCTG gAACTGgAAAAa | | X | | | n.d. |
| 4 | 2 | 2 | | aTCATCCTCAaC | AAACTA AAACaGgAAAAG | | X | | | |
| 4 | 4 | 0 | KIAA1680 | GgaATGCcCATC | ACCACA AAACTGCAAAAG | | X | | | n.d. |
| 5 | 5 | 0 | | GTttTgCTCcTg | TACTTC AAACTGCAAAAG | | X | | | n.d. |

TABLE 2

Sequencing statistics. The total number of interpretable sequences ("total sequences") and the number of analyzed sequences for each in vitro selection condition are shown. Analyzed sequences are non-repeated sequences containing no ambiguous nucleotides that, for post-selection sequences, contained reverse complementary overhang sequences of at least four bases, a signature used in this study as a hallmark of ZFN-mediated cleavage. "Incompatible overhangs" refer to sequences that did not contain reverse complementary overhang sequences of at least four bases. The high abundance of repeated sequences in the 0.5 nM, 1 nM, and 2 nM selections indicate that the number of sequencing reads obtained in those selections, before repeat sequences were removed, was larger than the number of individual DNA sequences that survived all experimental selection steps.

| | | | Rejected Sequences | | |
|---|---|---|---|---|---|
| | Total Sequences | Analyzed Sequences | Incompatible Overhangs | Repeated Sequences | Uncalled Bases in Half-Sites |
| CCR5-224 Pre-Selection | 1,426,442 | 1,392,578 | 0 | 33,660 | 206 |
| CCR5-224 0.5 nM | 649,348 | 52,552 | 209,442 | 387,299 | 55 |
| CCR5-224 1 nM | 488,798 | 55,618 | 89,672 | 343,442 | 66 |
| CCR5-224 2 nM | 1,184,523 | 303,462 | 170,700 | 710,212 | 149 |
| CCR5-224 4 nM | 1,339,631 | 815,634 | 352,888 | 170,700 | 159 |
| Total | 5,088,742 | 2,619,842 | 822,702 | 1,645,563 | 635 |
| VF2468 Pre-Selection | 1,431,372 | 1,393,183 | 0 | 38,128 | 91 |
| VF2468 0.5 nM | 297,650 | 25,851 | 79,113 | 192,671 | 15 |

TABLE 2-continued

Sequencing statistics. The total number of interpretable sequences ("total sequences") and the number of analyzed sequences for each in vitro selection condition are shown. Analyzed sequences are non-repeated sequences containing no ambiguous nucleotides that, for post-selection sequences, contained reverse complementary overhang sequences of at least four bases, a signature used in this study as a hallmark of ZFN-mediated cleavage. "Incompatible overhangs" refer to sequences that did not contain reverse complementary overhang sequences of at least four bases. The high abundance of repeated sequences in the 0.5 nM, 1 nM, and 2 nM selections indicate that the number of sequencing reads obtained in those selections, before repeat sequences were removed, was larger than the number of individual DNA sequences that survived all experimental selection steps.

|  | Total Sequences | Analyzed Sequences | Rejected Sequences | | |
|---|---|---|---|---|---|
|  |  |  | Incompatible Overhangs | Repeated Sequences | Uncalled Bases in Half-Sites |
| VF2468 1 nM | 148,556 | 24,735 | 19,276 | 104,541 | 4 |
| VF2466 2 nM | 1,362,058 | 339,076 | 217,475 | 805,433 | 74 |
| VF2468 4 nM | 1,055,972 | 397,573 | 376,364 | 261,991 | 44 |
| Total | 4,295,608 | 2,180,388 | 692,228 | 1,422,764 | 228 |

TABLE 3

Both ZFNs tested have the ability to cleave a large fraction of target sites with three or fewer mutations. The percentage of the set of sequences with 1, 2, or 3 mutations (muts) that can be cleaved by (a) the CCR5-224 ZFN and (b) the VF2468 ZFN is shown. Enrichment factors (EFs) were calculated for each sequence identified in the selection by dividing the observed frequency of that sequence in the post-selection sequenced library by the observed frequency of that sequence in the preselection library. The enrichment factors for the wild-type sequence (wt EFs) calculated for each in vitro selection stringency are shown in the first row of the table.

a

CCR5-224

|  | 4 nM (wt EF = 5.48) | | | 2 nM (wt EF = 8.11) | | | 1 nM (wt EF = 16.6) | | | 0.5 nM (wt EF = 24.9) | | |
|---|---|---|---|---|---|---|---|---|---|---|---|---|
|  | 1 mut | 2 muts | 3 muts | 1 mut | 2 muts | 3 muts | 1 mut | 2 muts | 3 muts | 1 mut | 2 muts | 3 muts |
| EF > 0 | 100% | 99.96% | 78% | 100% | 99% | 49% | 100% | 83% | 14% | 100% | 75% | 11% |
| EF > 1 | 100% | 93% | 55% | 100% | 84% | 42% | 100% | 68% | 14% | 100% | 58% | 11% |
| EF > 2 | 100% | 78% | 37% | 100% | 70% | 31% | 99% | 55% | 14% | 96% | 46% | 11% |
| EF > (.5 × wt EF) | 100% | 63% | 28% | 93% | 40% | 17% | 51% | 15% | 8% | 31% | 8% | 4% |
| EF > wt EF | 14% | 9% | 10% | 8% | 6% | 6% | 3% | 2% | 3% | 6% | 1% | 2% | b

VF2468

|  | 4 nM (wt EF = 16.7) | | | 2 nM (wt EF = 22.5) | | | 1 nM (wt EF = 30.2) | | | 0.5 nM (wt EF = 33.1) | | |
|---|---|---|---|---|---|---|---|---|---|---|---|---|
|  | 1 mut | 2 muts | 3 muts | 1 mut | 2 muts | 3 muts | 1 mut | 2 muts | 3 muts | 1 mut | 2 muts | 3 muts |
| EF > 0 | 100% | 95% | 38% | 100% | 92% | 26% | 100% | 47% | 5% | 100% | 44% | 4% |
| EF > 1 | 96% | 49% | 17% | 93% | 34% | 11% | 83% | 24% | 5% | 80% | 21% | 4% |
| EF > 2 | 69% | 31% | 10% | 83% | 23% | 7% | 74% | 17% | 5% | 61% | 14% | 4% |
| EF > (.5 × wt EF) | 57% | 15% | 4% | 30% | 10% | 2% | 11% | 6% | 1% | 9% | 5% | 1% |
| EF > wt EF | 7% | 1% | 1% | 7% | 1% | 0.4% | 7% | 1% | 0.4% | 7% | 1% | 0.3% |

TABLE 4

Potential CCR5-224 genomic off-target sites. The human genome was searched for DNA sequences surviving in vitro selection for CCR5-224 cleavage. Sites marked with an 'X' were found in the in vitro selection dataset. 'T' refers to the total number of mutations in the site, and '(+)' and '(−)' to the number of mutations in the (+) and (−) half-sites, respectively. Chromosomal coordinates from build 36 of the human genome are listed. Mutation frequency for each site is the percentage of sequences with insertions or deletions (indels) in the sequenced DNA from cultured K562 cells expressing active CCR5-224. Bolded red sites have significantly enriched indel percentages in the active nuclease sample compared to cells containing empty vector. The sequences of the sites are listed as 5' (+) half site/spacer/(−) half-site 3', therefore the (+) half-site is listed in the reverse sense as it is in the sequence profiles. Three sites were not tested since they did not yield site-specific PCR amplification products. Indels and totals are not shown for those sites that were not tested. P-values shown are for the one-sided alternative hypothesis that the indel frequency is greater for active ZFN treated cells than for cells not expressing ZFN.

| | mutations | | | | | | |
|---|---|---|---|---|---|---|---|
| | T | (+) | (−) | gene | build 36 coordinates | (+) half-site | spacer (−) half-site |
| CCR5-224 1 | 0 | 0 | 0 | CCR5 (coding) | chr3: 46389548-46389576 | GTCATCCTCATC | CTGAT AAACTGCAAAAG |
| CCR5-224 2 | 2 | 1 | 1 | CCR2 (coding) | chr3: 46374209-46374237 | GTCgTCCTCATC | TTAAT AAACTGCAAAAa |
| CCR5-224 3 | 3 | 2 | 1 | BTBD10 (promoter) | chr11: 13441738-13441766 | GTttTCCTCATC | AAAGC AAACTGCAAAAt |
| CCR5-224 4 | 4 | 0 | 4 | | chr10: 29604352-29604380 | GTCATCCTCATC | AGAGA AAACTGgctAAt |
| CCR5-224 5 | 4 | 3 | 1 | SLC4A8 | chr12: 50186653-50186882 | ttaaATCCTCATC | TCTATA AAAtGCAAAAG |
| CCR5-224 6 | 3 | 2 | 1 | Z83955 RNA | chr12: 33484433-33484462 | GTCATCCcaATC | GAAGAA AAACTGaAAAAG |
| CCR5-224 7 | 3 | 1 | 2 | DGKK | chrX: 50149961-50149989 | cTCATCCTCATC | CATGC AcAaTGCAAAAG |
| CCR5-224 8 | 3 | 1 | 2 | GALNT13 | chr2: 154567664-154567692 | GTCATCCTCAGC | ATGGG AAACaGCAgAAG |
| CCR5-224 9 | 3 | 1 | 2 | | chr17: 61624429-61624457 | GTCATCtTCATC | AAAAG gAACTGCAAAAc |
| CCR5-224 10 | 4 | 0 | 4 | | chrX: 145275453-145275481 | GTCATCCTCATC | CAATA AAAgaaCAAAgG |
| CCR5-224 11 | 4 | 1 | 3 | TACR3 | chr4: 104775175-104775203 | GTCATCtTCATC | AGCAT AAACTGtAAAgt |
| CCR5-224 12 | 4 | 1 | 3 | PIWIL2 | chr8: 22191670-22191698 | GTCATCCTCATa | CATAA AAACTGCcttAG |
| CCR5-224 13 | 4 | 1 | 3 | | chr9: 76194351-76194379 | aTCATCCTCATC | CATCC AAtgTtCAAAAG |
| CCR5-224 14 | 4 | 3 | 1 | | chr8: 52114315-52114343 | GTCcTgCTCAgC | AAAAG AAACTGaAAAAG |
| CCR5-224 15 | 4 | 3 | 1 | KCNB2 | chr8: 73389370-73898298 | aTgtTCCTCATC | TCCCG AAACTGCAAAtG |
| CCR5-224 16 | 4 | 3 | 1 | | chr8: 4865886-4865914 | GTCtTCCTgATg | CTACC AAACTGgAAAAG |
| CCR5-224 17 | 4 | 3 | 1 | | chr9: 14931072-14931100 | aaCATCCaCATC | ATGAA AAACTGCAAAAa |
| CCR5-224 18 | 6 | 3 | 3 | | chr13: 65537258-65537286 | aTCtTCCTCATt | ACAGG AAAaTGtAAtAG |
| CCR5-224 19 | 6 | 4 | 2 | CUBN | chr10: 17044849-17044877 | GgCtTCCTgAcC | CACGG AAACTGtAAAtG |
| CCR5-224 20 | 6 | 5 | 1 | NID1 | chr1: 234244827-234244855 | GTttTgCaCATt | TCAAT tAACTGCAAAAG |
| CCR5-224 21 | 3 | 2 | 1 | | chr9: 80584200-80584229 | GTCAaCCTCAaC | ACCTAC AgACTGCAAAAG |
| CCR5-224 22 | 4 | 1 | 3 | WWOX | chr16: 77185306-77185335 | GTCATCCTCcTC | CAACTC cAAtTGCtAAAG |
| CCR5-224 23 | 4 | 2 | 2 | AMBRA1 | chr11: 46422600-46422829 | GTCtTCCTCcTC | TGCACA tcACTGCAAAAG |
| CCR5-224 24 | 4 | 2 | 2 | | chr1: 994566-16-99456645 | GTgATaCTCATC | ATCAGC AAtCTGCAtAAG |
| CCR5-224 25 | 4 | 2 | 2 | WBSCR17 | chr7: 70557254-70557283 | GTATCCTCAgC | AAACTA AAACTGgAAcAG |
| CCR5-224 26 | 4 | 2 | 2 | ITSN | chr21: 34098210-34098239 | cTCATgCTCATC | ATTTGT tAACTGCAAAAt |
| CCR5-224 27 | 4 | 4 | 0 | | chr9: 106457399-106457428 | GcCAgtCTCAgC | ATGGTG AAACTGCAAAAG |
| CCR5-224 28 | 4 | 4 | 0 | | chr17: 49929141-49929170 | CTCATtCTgtTC | ATGAAA AAACTGCAAAAG |
| CCR5-224 29 | 5 | 3 | 2 | | chr15: 96714952-96714981 | GaagTCCTCATC | CCGAAG AAACTGaAAgAG |

TABLE 4-continued

Potential CCR5-224 genomic off-target sites. The human genome was searched for DNA sequences surviving in vitro selection for CCR5-224 cleavage. Sites marked with an 'X' were found in the in vitro selection dataset. 'T' refers to the total number of mutations in the site, and '(+)' and '(−)' to the number of mutations in the (+) and (−) half-sites, respectively. Chromosomal coordinates from build 36 of the human genome are listed. Mutation frequency for each site is the percentage of sequences with insertions or deletions (indels) in the sequenced DNA from cultured K562 cells expressing active CCR5-224. Bolded red sites have significantly enriched indel percentages in the active nuclease sample compared to cells containing empty vector. The sequences of the sites are listed as 5' (+) half site/spacer/(−) half-site 3', therefore the (+) half-site is listed in the reverse sense as it is in the sequence profiles. Three sites were not tested since they did not yield site-specific PCR amplification products. Indels and totals are not shown for those sites that were not tested. P-values shown are for the one-sided alternative hypothesis that the indel frequency is greater for active ZFN treated cells than for cells not expressing ZFN.

| Site | T | (+) | (−) | Gene | Coordinates | Sequence |
|---|---|---|---|---|---|---|
| CCR5-224 30 | 5 | 3 | 2 | ZNF462 | chr9: 108684858-108684687 | GTCtTCCTCtTt CACATA AAACcGCAAAtG |
| CCR5-224 31 | 5 | 4 | 1 | | chr5: 101113644-101113673 | aTaATCCTTtTC TGTTTA AAACaGCAAAAG |
| CCR5-224 32 | 5 | 4 | 1 | | chr17: 43908810-43908839 | GaCATCCaaATt ACATGG AAACTGaAAAAG |
| CCR5-224 33 | 5 | 5 | 0 | SDK1 | chr7: 3446932-3446961 | GTCtTgCTgTTg CACCTC AAACTGCAAAAG |
| CCR5-224 34 | 4 | 1 | 3 | SPTB(coding) | chr14: 64329872-64329901 | GTCATCCgCATC GCCCTG gAACTGgAAAAa |
| CCR5-224 35 | 4 | 2 | 2 | | chr10: 54268729-54268758 | aTCATCCTCAaC AAACTA AAACaGgAAAAG |
| CCR5-224 36 | 4 | 4 | 0 | KIAA1680 | chr4: 92322851-92322880 | GgaATgCcCATC ACCACA AAACTGCAAAAG |
| CCR5-224 37 | 5 | 5 | 0 | | chr5: 114708142-114708171 | GTttTgCTCcTg TACTTC AAACTGCAAAAG |

Table 4. Continued below; (+) half-sites SEQ ID NOs: 190-226 descending; (−) half sites SEQ ID NOs: 227-263 descending; full sequence with spacer descending SEQ ID NOs: 264-300.

| in vitro selection stringency | | | | empty vector | | | active CCR5-224 | | | |
|---|---|---|---|---|---|---|---|---|---|---|
| 4 nM | 2 nM | 1 nM | 0.5 nM | indels | total | mutation frequency | indels | total | mutation frequency | p-value |
| X | X | X | X | 1 | 226676 | 0.00044% | 105639 | 240968 | 44% | 0 |
| X | X | X | X | 0 | 114904 | | 12856 | 130488 | 10% | 0 |
| X | X | | | 1 | 293015 | 0.00035% | 166 | 224000 | 0.070% | 0 |
| X | X | | | 2 | 297084 | 0.00067% | 3 | 245078 | 0.0012% | 0.26 |
| X | X | | | 0 | 147246 | | 0 | 138979 | | |
| X | | | X | 0 | 147157 | | 1 | 146283 | 0.00068% | 0.16 |
| X | | | | 0 | 316468 | | 0 | 313981 | | |
| X | | | | 0 | 136684 | | 0 | 94657 | | |
| X | | | | 0 | 178692 | | 52 | 146525 | 0.035% | 2.7E-13 |
| X | | | | 0 | 296730 | | 0 | 276961 | | |
| X | | | | 0 | 273436 | | 1045 | 308726 | 0.34% | 0 |
| X | | | | | | | | | | |
| X | | | | 0 | 168244 | | 1 | 171618 | 0.00058% | 0.16 |
| X | | | | 0 | 66317 | | 35 | 136728 | 0.025% | 1.6E-08 |
| X | | | | 1 | 427161 | 0.00023% | 260 | 393899 | 0.071% | 0 |
| X | | | | 0 | 190993 | | 32 | 171160 | 0.019% | 7.7E-08 |
| X | | | | 0 | 163704 | | 0 | 146176 | | |
| X | | | | 0 | 109939 | | 0 | 100948 | | |
| X | | | | | | | | | | |
| X | | | | 0 | 114743 | | 0 | 120169 | | |

TABLE 4-continued

Potential CCR5-224 genomic off-target sites. The human genome was searched for
DNA sequences surviving in vitro selection for CCR5-224 cleavage. Sites marked with an 'X'
were found in the in vitro selection dataset. 'T' refers to the total number of mutations
in the site, and '(+)' and '(-)' to the number of mutations in the (+) and (-) half-sites,
respectively. Chromosomal coordinates from build 36 of the human genome are listed. Mutation
frequency for each site is the percentage of sequences with insertions or deletions
(indels) in the sequenced DNA from cultured K562 cells expressing active CCR5-224.
Bolded red sites have significantly enriched indel percentages in the active nuclease sample
compared to cells containing empty vector. The sequences of the sites are listed as 5' (+)
half site/spacer/(-) half-site 3', therefore the (+) half-site is listed in the reverse sense
as it is in the sequence profiles. Three sites were not tested since they did not yield
site-specific PCR amplification products. Indels and totals are not shown for those sites
that were not tested. P-values shown are for the one-sided alternative hypothesis that the
indel frequency is greater for active ZFN treated cells than for cells not expressing ZFN.

| | | | | | | | |
|---|---|---|---|---|---|---|---|
| X | | 0 | 188149 | | 127 | 213248 | 0.060% | 0 |
| X | | 0 | 366156 | | 0 | 354878 | | |
| X | | 0 | 237240 | | 0 | 227568 | | |
| X | | 0 | 129468 | | 0 | 144274 | | |
| X | | 0 | 172543 | | 488 | 417198 | 0.12% | 0 |
| X | | 0 | 267772 | | 0 | 308093 | | |
| X | | 0 | 350592 | | 0 | 335281 | | |
| X | | 0 | 105012 | | 0 | 99968 | | |
| X | | 0 | 355674 | | 0 | 338910 | | |
| X | | 0 | 173646 | | 1 | 152744 | 0.00065% | 0.16 |
| X | | 1 | 245650 | 0.00041% | 0 | 185572 | | 0.84 |
| X | | 0 | 482635 | | 2 | 413317 | 0.00048% | 0.079 |
| X | | 0 | 237791 | | 0 | 200398 | | |
| | X | 0 | 180783 | | 0 | 167885 | | |
| | X | | | | | | | |
| | X | 0 | 165657 | | 2 | 153995 | 0.0013% | 0.079 |
| | X | 0 | 152083 | | 0 | 183305 | | |

TABLE 5

There are many more potential genomic VF2468 target
sites than CCR5-224 target sites. The human genome
was computationally searched for sites up to nine mutations
away from the canonical CCR5-224 target site and up to
six mutations away from the canonical VF2468 target site.
The number of occurrences of sites containing five or six
base pair spacers in the genome, including repeated
sequences, is listed in the table.

| CCR5-224 | | VF2468 | |
|---|---|---|---|
| # of mutations | # of site in genome | # of mutations | # of sites in genome |
| 0 | 1 | 0 | 1 |
| 1 | 0 | 1 | 3 |
| 2 | 1 | 2 | 245 |
| 3 | 6 | 3 | 3,201 |
| 4 | 99 | 4 | 35,995 |
| 5 | 964 | 5 | 316,213 |
| 6 | 9,671 | 6 | 2,025,878 |
| 7 | 65,449 | | |
| 8 | 372,801 | | |
| 9 | 1,854,317 | | |

TABLE 6

Sequences of CCR5-224-mediated genomic DNA modifications identified in cultured human K562 cells (SEQ ID NOs: 301-365, descending, then left to right). Sequences with insertions (blue) and deletions (red) identified after sequencing potential CCR5-224 off-target sites from cultured K562 cells expressing CCR5-224 are shown. The numbers of occurrences are shown to the right of each sequence. Other mutations are indicated with lowercase letters and likely reflect mutations that arose during PCR or sequencing. The unmodified site is listed under the gene name or coordinates (build 36), and the spacer sequence is underlined.

| | # of sequences | | # of sequences |
|---|---|---|---|
| BTBD10 (promoter) | | chr6: 52114315-52114343 | |
| ATTTTGCAGTTT GCTTT GATGAGGAAAAC | | CTTTTTCAGTTT CTTTT GCTGAGCAGGAC | |
| ATTTTGCAGTTT GCTTT GATGAGGAAAAC | 63 | CTTTTTCAGTTT CTTTT GCTGAGCAGGAC | 35 |
| ATTTTGCAGTTT GCTTTGCTTT GATGAGGAAAAC | 86 | | |
| ATTTTGCAGTTT GcTTTGCTTT GATGAGGAAAAC | 1 | KCNB2 | |
| ATTTTGCAGTTT GCTTTGCTTT GgTGAGGAAAAC | 1 | CATTTGCAGTTT CGGGA GATGAGGAACAT | |
| gTTTTGCAGTTT GCTTTGCTTT GATGAGGAAAAC | 1 | | |
| CTTTTGCAGgTT GCTTTGCTTT GATGAGGAAAAC | 1 | CATTTGCAGTTT CGGGAGA GATGAGGAACAT | 158 |
| ATTTTGCAGTTT GCTTTGCTTT GATGtGGAAAAC | 1 | CATTTGCAGTTa CGGGAGA GATGAGGAACAT | 1 |
| ATTTTGCAGTTT GCTTT GATGAGGAAAAC | 1 | CATTTGCAGTTT CGGGAGA GATGAGGgACAT | 1 |
| | | CATTTGacGcTT CGGGAGA GgTGAGGgACAT | 1 |
| chr17: 61824429-51624457 | | CATTTGCAGTTT CGGGCGGGA GATGAGGAACAT | 109 |
| GTTTTGCAGTTC CTTTT GATGAAGATGAC | | CATTTGCAGTTT CGGGCGGGA GATGcGGAACAT | 1 |
| | | CATTTGCAGTTT CGGGCGGGc GATGAGGAACAT | 1 |
| GTTTTGCAGTTC CTTTT GATGAAGATGAC | 51 | CATTTGCAGTTT CGGGCGGGA GgTGAGGAACAT | 1 |
| GTTTTGCAGgTC CTTTT GATGAAGATGAC | 1 | CgTTTGCAGTTT CGGGCGGGA GATGAGGAACAT | 2 |
| | | CATTTGCtGTTT CGGGCGGGA GATGAGGAACAT | 1 |
| TACR3 | | CATTTGCAGTTT CGGGCGGGA GATGAGGAcCAT | 1 |
| ACTTTACAGTTT ATGCT GATGAAGATGAC | | CATTTGCAGTTT CGGGCGGGA GATGAGGAcCAT | 1 |
| | | CcTTTGCAGTTT CGGGCGGGA GATGAGGAACAT | 1 |
| ACTTTACAGTTT ATGCT GATGAAGATGAC | 5 | CATTTGCAGTTg CGGGCGGGA GATGAGGAACAT | 1 |
| ACTTTACAGTTT ATGCT GATGAAGATGAC | 169 | | |
| gCTTTACAGTTT ATGCT GATGAAGATGAC | 1 | chr8: 4865886-4865914 | |
| ACTTTACAGTTT ATGCT GATGAAGATtAC | 1 | GTCTTCCTGATG CTACC AAACTGGAAAAG | |
| ACTTTACAGTTT ATGCT GATGAAGATGAtt | 1 | | |
| ACTTTACAGTTT ATGCT GATGAAGATGAC | 34 | GTCTTCCTGATG CTACC AAACTGGAAAAG | 30 |
| ACTTTACgGTTT ATGCT GATGAAGATGAC | 1 | GTCTTCCTGATG CTACC AAACTgGAAAAG | 1 |
| ACTTTACAGTTT ATGCT GATGAAGATGAC | 180 | GTCTTCaTGATG CTACC AAACTGGAAAAG | 1 |
| ACTTTACAGTTT ATGCT GATGAAGATGcC | 1 | | |
| ACTTTACAGTTT ATGCTATGCT GATGAAGATGAC | 507 | chr9: 80584200-80584229 | |
| gCTTTACAGTTT ATGCTATGCT GATGAAGATGAC | 1 | CTTTTGCAGTCT GTAGGT GTTGAGGTTGAC | |
| ACTTTACgGTTT ATGCTATGCT GATGAAGATGAC | 1 | | |
| ACTTTACAGTTT ATGCTATGCT GATGAtGATGAC | 1 | CTTTTGCAGTCT GTAGGT GTTGAGGTTGAC | 125 |
| ACgTTACAGTTT ATGCTATGCT GATGAAGATGAC | 1 | CTTTTGCAGTCT GTAGGT GTTGAGGTTGAC | 1 |
| ACTTTACAGTTT ATGCT GATGAAGATGAC | 140 | CTTTTGCAGTCT GTAGGT GTTGAGGTTGAC | 1 |
| ACTTTACAGTTT ATGCT GATGAAGATGtC | 1 | | |
| WBSCR17 | | | |
| GTTATCCTCAGC AAACTA AAACTGGAACAG | | | |
| GTTATCCTCAGC AAACTA ACTA AAACTGGAACAG | 128 | | |
| GTTATCCTCAGC AAACTA AAACTGGAACAG | 118 | | |
| GTTATCCTCAGC AAACTA AAACTGGgACAG | 1 | | |
| GTTATCCTCAGC AAACTA AAACTGGAcCAG | 1 | | |
| GTTATaCTCAGC AAACTA AAACTGGAACAG | 1 | | |
| GTTATCCTCAGC AAACTA AAACTGGAACAG | 116 | | |
| aTTATCCTCAGC AAACTA AAACTGGAACAG | 1 | | |
| GTTATCCTtAGC AAACTA AAACTGGAACAG | 1 | | |
| GTTATCCTCAGC AAACTA AAACTGGAACAG | 116 | | |
| GaTATCCTCAGC AAACTA AAACTGGAACAG | 1 | | |

(Table 6 is presented as follows in four sections).    Table 6—section one of four:

TABLE 7

Potential VF2468 genomic off-target sites. DNA for 90 out of 97 potential VF2468 genomic target sites were amplified by PCR from cultured K562 cells expressing active VF2468ZFN or from cells containing empty expression vector (SEQ ID NOs: 366-653). Mutation frequency for each site is the percentage of sequences with insertions or deletions (indels) in the sequenced DNA from cultured K562 cells expressing active VF2468.

| | mutations | | | gene | build 36 coordinates | (+) half-site | spacer | (−) half-site |
|---|---|---|---|---|---|---|---|---|
| | T | (+) | (−) | | | | | |
| VF2468 1 | 0 | 0 | 0 | VEGF-A (promoter) | chr8: 43,846,383-43,845,415 | AGCAGCGTC | TTCGA | GAGTGAGGA |
| VF2468 2 | 1 | 0 | 1 | | chr1: 158,832,650-1468,832,672 | AGCAGCGTC | AATAC | GAGTGAaGA |
| VF2468 3 | 1 | 1 | 0 | | chr1: 242,574,122-242,574,144 | AGCAGCcTC | TGCTT | GAGTGAGGA |
| VF2468 4 | 1 | 1 | 0 | ZNF683 | chr1: 26,569,668-26,869,690 | AGCAGCGTt | GGGAG | GAGTGAGGA |
| VF2468 5 | 2 | 0 | 2 | GSG1L | chr1: 27,853984-27,854,006 | AGCAGCGTC | AAAAA | GAGTGAGcA |
| VF2468 6 | 2 | 0 | 2 | C9orf98 | chr9: 134,636,934-134,696,956 | AGCAGCGTC | GTGTG | GtGTGAGGt |
| VF2468 7 | 2 | 0 | 2 | EFHD1 | chr2: 233,205,384-233,205,407 | AGCAGCGTC | GTTCTC | aAGTGGGGA |
| VF2468 8 | 2 | 0 | 2 | | chr20: 30,234,845-30,234,868 | AGCAGCGTC | TAGGCA | GAGaGAaGA |
| VF2468 9 | 2 | 0 | 2 | KIAA0841 (exon-Intron) | chr19: 40,800,787-40,800,820 | AGCAGCGTC | TAGGGG | GAGgGAGGg |
| VF2468 10 | 2 | 0 | 2 | CES7 | chr16: 54,501,918-54,501,940 | AGCAGCGTC | TCAAAA | GAGTGtGcA |
| VF2468 11 | 2 | 0 | 2 | PTK2B | chr8: 27,338,855-27,338,878 | AGCAGCGTC | TCCCTT | GAGTGAtGg |
| VF2468 12 | 2 | 0 | 2 | | chr9: 137,315,499-137,315,521 | AGCAGCGTC | TGAAA | GAGTGAaaA |
| VF2468 13 | 2 | 1 | 1 | | chr20: 7,985,741-7,985,493 | AGaAGCGTC | ATCGA | GAGTGAGGt |
| VF2468 14 | 2 | 1 | 1 | | chrY: 8,461,018-8,451,041 | AGCAaCGTC | AGATAG | GgGTGAGGA |
| VF2468 15 | 2 | 1 | 1 | | chr1: 53,720,668-53,720,690 | AGCAaCGTC | ATATT | cAGTGAGGA |
| VF2468 16 | 2 | 1 | 1 | | chrX: 122,132,519-122,132,541 | AGCAaCGTC | GTAGT | GAtTGAGGA |
| VF2468 17 | 2 | 1 | 1 | | chr10: 4,506,346-74,506,368 | AGCAcCGTC | TTTTC | tAGTGAGGA |
| VF2468 18 | 2 | 1 | 1 | F4HA1 | chrX: 56,830,910-56,830,933 | AGCAGaGTC | AGACTT | GAGTGAGgt |
| VF2468 19 | 2 | 1 | 1 | DFKZp686L07201 | chr1: 54,881,895-54,881,917 | AGCAGaGTC | TCTGA | GAGTGAGGc |
| VF2468 20 | 2 | 1 | 1 | TTC4 | chr1: 175,647,668-175,647,690 | AGCAGCATC | AGTGA | GAGTGAGGc |
| VF2468 21 | 2 | 1 | 1 | | chr1: 50,490,333-50,490,356 | AGCAGCcTC | TCCAAA | GAGTGAGGt |
| VF2468 22 | 2 | 1 | 1 | | chr4: 128,224,847-128,224,870 | AGCAGCcTC | TGCATC | GAGTGAGGA |
| VF2468 23 | 2 | 1 | 1 | | chr13: 27,399,187-27,399,210 | AGCAGCGaC | GCCTGG | GAGTGAGgt |
| VF2468 24 | 2 | 1 | 1 | | chr16: 62,603,303-62,603,326 | AGCAGCGTa | TCACAT | GAGTGAGGg |
| VF2468 25 | 2 | 1 | 1 | | chr11: 69,063,501-69,063,523 | AGCAGCGTg | CCCAA | GAGTGAGGc |
| VF2468 26 | 2 | 1 | 1 | | chr1: 173,885,442-173,885,465 | AGCAGCtTC | AGGGGGA | GtGTGAGGA |
| VF2468 27 | 2 | 1 | 1 | TNR | chr18: 8,320,310-8,320,332 | AGCAGCtTC | CTTTT | GAGTGAGaA |
| VF2468 28 | 2 | 1 | 1 | PTPRM | chr12: 25,724,566-25,724,589 | AGCAGCtTC | TCCTGG | GAGTGAGgg |
| VF2468 29 | 2 | 1 | 1 | | chr13: 82,039,140-82,039,163 | AGCAGgTC | AGGGCT | GAGTGAGGc |
| VF2468 30 | 2 | 1 | 1 | | chr3: 131,201,895-131,201,918 | AGCAGtGTC | AGGCTG | GtGTGAGGt |
| VF2468 31 | 2 | 1 | 1 | | chr3: 75,709,387-75,709,410 | AGCAGtGTC | AGGCTG | GtGTGAGGA |
| VF2468 32 | 2 | 1 | 1 | | chr11: 3,556,299-3,556,332 | AGCAGtGTC | AGGCTG | GtGTGAGGA |
| VF2468 33 | 2 | 1 | 1 | | chr3: 126,970,762-126,970,785 | AGCAGtGTC | AGGCTG | GtGTGAGGA |
| VF2468 34 | 2 | 1 | 1 | | chr11: 71,030,884-71,030,907 | AGCAGtGTC | CTAAGG | GtGTGAGGA |
| VF2468 35 | 2 | 1 | 1 | SBF2/U80769 | chr1: 9,884,211-9,884,234 | AGCAtCGTC | ATCAGA | GgGTGAGGA |
| VF2468 36 | 2 | 1 | 1 | KRI1 (coding) | chr19: 10,534,492-10,534,515 | AGCAtCGTC | TGAAGT | cAGTGAGGc |
| VF2468 37 | 2 | 1 | 1 | MICAL3/KIAA1364 | chr6: 112,421,476-112,421,499 | AGCAtCGTC | TTCTGT | cAGTGAGGc |
| VF2468 38 | 2 | 1 | 1 | MUC16 (exon-Intron) | chr22: 16,718,914-16,718,937 | AGCAtCGTC | TCACCT | GAGTGAgtA |
| VF2468 39 | 2 | 1 | 1 | | chr19: 8,894,218-8,894,241 | AGaAGCGTC | ATCTCG | GAGTGAGGc |
| VF2468 40 | 2 | 2 | 0 | | chr8: 5,638,000-6,638,023 | AaCAGCtTC | TCGGGA | GAGTGAGGA |
| VF2468 41 | 2 | 2 | 0 | PREX1 | chr20: 46,733,644-46,733,667 | AaCAGCtTC | TCGGGA | GAGTGAGGA |

TABLE 7-continued

Potential VF2468 genomic off-target sites. DNA for 90 out of 97 potential VF2468 genomic target sites were amplified by PCR from cultured K562 cells expressing active VF2468ZFN or from cells containing empty expression vector (SEQ ID NOs: 366-653). Mutation frequency for each site is the percentage of sequences with insertions or deletions (indels) in the sequenced DNA from cultured K562 cells expressing active VF2468.

| | | | | | | | |
|---|---|---|---|---|---|---|---|
| VF2468 42 | 2 | 2 | 0 | CDH20 | chr18: 57,303,454-57,303,477 | AaCAGCtTC | TCTGAG | GAGTGAGGA |
| VF2468 43 | 2 | 2 | 0 | | chr20: 6,213,500-6,213,522 | AGCAaaGTC | AAACA | GAGTGAGGA |
| VF2468 44 | 2 | 2 | 0 | | chr5: 85,841,308-85,841,331 | AGCAacTtC | TGGAAA | GAGTGAGGA |
| VF2468 45 | 2 | 2 | 0 | | chr8: 20,481,270-20,481,292 | AGCAcCtTC | AATTG | GAGTGAGGA |
| VF2468 46 | 2 | 2 | 0 | | chr5: 95,417,045-95,417,068 | ACAGCaTa | ATAGCA | GAGTGAGGA |
| VF2468 47 | 2 | 2 | 0 | | chr15: 59,165,302-59,165,325 | ACAGCaTa | GATATG | GAGTGAGGA |
| VF2468 48 | 2 | 2 | 0 | RORA | chr6: 24,504,489-24,504,511 | ACAGCaTa | TCAGG | GAGTGAGGA |
| VF2468 49 | 2 | 2 | 0 | | chr3: 31,085,287-31,085,309 | AGCAGCGag | AAAGA | GAGTGAGGA |
| VF2468 50 | 2 | 2 | 0 | | chr6: 27,579,690-27,579,712 | AGCAGCGgt | CTTAG | GAGTGAGGA |
| VF2468 51 | 2 | 2 | 0 | | chr12: 113,410,592-113,410,615 | AGCAGgGTt | CTTCAA | GAGTGAGGA |
| VF2468 52 | 2 | 2 | 0 | | chr1: 11,399,534-11,399,556 | AGCtGaGTC | CTAAA | GAGTGAGGA |
| VF2468 53 | 2 | 2 | 0 | | chr5: 94,590,016-94,590,038 | AGCtGaGTC | TTAAG | GAGTGAGGA |
| VF2468 54 | 2 | 2 | 0 | MCTP1 | chr1: 13,394,902-13,394,924 | AGCtGgGTC | ATGAG | GAGTGAGGA |
| VF2468 55 | 2 | 2 | 0 | PRAMEF20 | chr1: 13,615,741-13,615,763 | AGCtGtGTC | CACAG | GAGTGAGGA |
| VF2468 56 | 2 | 2 | 0 | | chr20: 59,154,784-59,154,806 | AGCtGtGTC | TTGGA | GAGTGAGGA |
| VF2468 57 | 2 | 2 | 0 | | chr14: 100,903,675-100,903,697 | AGCtGtGTC | AAATT | GAGTGAGGA |
| VF2468 58 | 2 | 2 | 0 | | chrX: 141,701,170-141,701,192 | AGtAGCGgC | CCAGT | GAGTGAGGA |
| VF2468 59 | 2 | 2 | 0 | GTF3C1 | chr15: 27,452,953-27,452,975 | AGtgGCGTC | CTAGA | GAGTGAGGA |
| VF2468 60 | 2 | 2 | 0 | DNMBP/AK089111 | chr10: 101,688,961-101,688,983 | gGCAGaGTC | CTCCCA | GAGTGAGGA |
| VF2468 61 | 2 | 2 | 0 | | chr6: 137,852,455-137,852,478 | tcCAGCGTC | GTAGGG | GAGTGAGGA |
| VF2468 62 | 2 | 2 | 0 | SARDH | chr9: 135,592,239-135,592,262 | tGCAGCGgC | GTAGGG | GAGTGAGGA |
| VF2468 63 | 2 | 2 | 0 | | chr7: 19,683,400-19,683,423 | tGCAGCGTC | AAAATA | GAGTGAGGA |
| VF2468 64 | 2 | 2 | 0 | ZNF628 | chr19: 60,683,246-60,683,269 | tGCAGgGTC | GGGCAG | GAGTGAGGA |
| VF2468 65 | 2 | 2 | 0 | | chr3: 130,430,426-130,430,448 | tGCAGtGTC | CACAA | GAGTGAGGA |
| VF2468 66 | 2 | 3 | 1 | GBF1 | chr10: 104,073,989-104,074,012 | AGCAaCGTC | CATAGT | GtGTGAGaA |
| VF2468 67 | 2 | 3 | 1 | | chr14: 96,561,728-96,561,751 | AGCAaCGTC | TAACCC | GAGTGtTGA |
| VF2468 68 | 2 | 3 | 1 | PDE9A | chr21: 42,982,083-42,982,105 | AGCAcCGTC | CCCCT | cAGTGAGGA |
| VF2468 69 | 2 | 3 | 1 | MTX2 | chr2: 176,842,448-176,842,470 | AGCAGCGgC | GGCTG | cAGTGAGGc |
| VF2468 70 | 2 | 3 | 1 | | chr6: 104,071,040-104,071,063 | AGCAGCGgC | TTAAGG | GgGTGAGGt |
| VF2468 71 | 2 | 3 | 1 | | chr3: 32,220,862-32,220,885 | AGCAGtGTC | TAAAAG | GAGTGAGat |
| VF2468 72 | 2 | 3 | 1 | | chr2: 11,429,195-11,429,218 | AGaAaCGTC | GTGGAG | GAGTGAGaA |
| VF2468 73 | 2 | 3 | 1 | OPN5 | chr6: 47,891,415-47,891,438 | AGCAaaGTC | TGTACT | GAGTGAGGg |
| VF2468 74 | 2 | 3 | 1 | | chr2: 195,362,417-195,362,439 | AGCAacATC | ATCTT | GAGTGAGGg |
| VF2468 75 | 2 | 3 | 1 | MIPOL1 | chr14: 36,952,701-36,952,724 | AGCAacATC | TGGTTG | GAGTGAGGt |
| VF2468 76 | 2 | 3 | 1 | | chr4: 138,603,959-138,603,981 | AGCAacttC | ATCTT | GAGTGAGGt |
| VF2468 77 | 2 | 3 | 1 | LRCH1 | chr13: 46,079,921-46,079,943 | AGCActtTC | CTGGC | GAGTGAGGg |
| VF2468 78 | 2 | 3 | 1 | KIAA0999 | chr11: 116,292,384-116,292,406 | AGCAatgTC | AAAAA | GAGTGAGGc |
| VF2468 79 | 2 | 3 | 1 | | chr12: 13,353,629-13,353,651 | AGCAcCGTg | GCTTC | GAGTGAGGc |
| VF2468 80 | 2 | 3 | 1 | PLXNA4 (coding) | chr7: 131,503,708-131,503,730 | AGCAcgGTC | ATGAT | GAGTGAGGc |
| VF2468 81 | 2 | 3 | 1 | TSPEAR | chr21: 44,817,259-44,817,282 | AGCAGCagC | CCACAG | GAGTGAGGc |
| VF2468 82 | 2 | 3 | 1 | | chr18: 74,634,790-74,634,812 | AGCAGCagC | TAGGG | GAGTGAGGt |
| VF2468 83 | 2 | 3 | 1 | | chr10: 33,904,306-33,904,328 | AGCAacttC | TCTCC | GAGTGAGGc |
| VF2468 84 | 2 | 3 | 1 | | chr6: 170,226,156-170,226,178 | AGCAGgGTg | GCGTG | GAGTGAGGt |
| VF2468 85 | 2 | 3 | 1 | HRASLS | chr3: 118,594,878-118,594,901 | AGCAtaGTC | TAGGCC | GAGTGAGGc |
| VF2468 86 | 2 | 3 | 1 | | chr3: 194,452,125-194,452,147 | AGCAtgGTC | CCAAG | GAGTGAGGg |
| VF2468 87 | 2 | 3 | 1 | | chr17: 19,434,508-19,434,531 | AGCAttGTC | TCATGT | GAGTGAGGt |
| VF2468 88 | 2 | 3 | 1 | | chr8: 125,982,579-125,982,601 | AGCAttGTC | TCCTG | GAGTGAGGg |

TABLE 7-continued

Potential VF2468 genomic off-target sites. DNA for 90 out of 97 potential VF2468 genomic target sites were amplified by PCR from cultured K562 cells expressing active VF2468ZFN or from cells containing empty expression vector (SEQ ID NOs: 366-653). Mutation frequency for each site is the percentage of sequences with insertions or deletions (indels) in the sequenced DNA from cultured K562 cells expressing active VF2468.

| | | | | | | | | | In vitro selection stringency | | | | | empty vector | | | active VF2468 | | |
|---|---|---|---|---|---|---|---|---|---|---|---|---|---|---|---|---|---|---|---|
| | | | | | | | | | 4 nM | 2 nM | 1 nM | 0.5 nM | indels | total | mutation frequency | indels | total | mutation frequency | p-value |
| VF2468 89 | 3 | 2 | 1 | | UHRF1BP1L | chr12: 99,011,715-99,011,737 | AGtAGCGTt | TTTAG | | | | | | | | | | | |
| VF2468 90 | 3 | 2 | 1 | | | chr1: 14,762,405-14,762,427 | AtCAGaGTC | TCTGG | | | | | | | | | | | 0.16 |
| VF2468 91 | 3 | 2 | 1 | LAMB3 (promoter) | | chr1: 207,894,359-,207,894,382 | AtCAGtGTC | CCTCAG | | | | | | | | | | | |
| VF2468 92 | 3 | 2 | 1 | BRUNOL4 | | chr18: 33,160,009-33,160,032 | gGCAGaGTC | AGGGCT | | | | | | | | | | | |
| VF2468 93 | 3 | 2 | 1 | | | chr16: 84,004,297-84,004,320 | gGCAGcGGc | CGCTGT | | | | | | | | | | | |
| VF2468 94 | 3 | 2 | 1 | DFKZp586E1619/BRD | | chr22: 48,558,064-48,558,086 | tGCAGctTC | ATGGT | | | | | | | | | | | |
| VF2468 95 | 3 | 3 | 0 | | | chr7: 22,054,784-22,054,807 | AGCAtAGTt | ACCTGG | | | | | | | | | | | |
| VF2468 96 | 3 | 3 | 1 | | | chr14: 25,876,126-25,876,149 | AGtAaaGTC | TAAGTA | | | | | | | | | | | |
| VF2468 97 | 3 | 4 | | CNNM2 | | chr10: 104716,593-104,716,615 | tGCAGtcTC | CTTGG | | | | | | | | | | | |
| VF2468 1 | | | | | | | | | X | X | X | X | 126 | 147187 | 0.085% | 27067 | 186785 | 14% | 0 |
| VF2468 2 | | | | | | | | | X | X | X | X | 0 | 57855 | | 1 | 62195 | 0.0016% | 0.16 |
| VF2468 3 | | | | | | | | | X | X | X | X | 0 | 167447 | | 0 | 147340 | | |
| VF2468 4 | | | | | | | | | X | X | X | X | 0 | 111340 | | 0 | 109365 | | |
| VF2468 5 | | | | | | | | | X | X | X | X | 0 | 80047 | | 0 | 69080 | | |
| VF2468 6 | | | | | | | | | X | X | X | X | | | | | | | |
| VF2468 7 | | | | | | | | | X | X | X | X | 0 | 202694 | | 0 | 204809 | | |
| VF2468 8 | | | | | | | | | X | X | X | X | 0 | 160769 | | 1 | 158886 | 0.00063% | 0.16 |
| VF2468 9 | | | | | | | | | X | X | X | X | 1 | 81164 | 0.0012% | 445 | 79136 | 0.56% | 0 |
| VF2468 10 | | | | | | | | | X | X | X | X | 1 | 168501 | 0.00059% | 0 | 144701 | | 0.84 |
| VF2468 11 | | | | | | | | | X | X | X | X | 0 | 179502 | | 56 | 138649 | 0.040% | 3.6E-14 |
| VF2468 12 | | | | | | | | | X | X | X | X | 0 | 285530 | | 165 | 254714 | 0.065% | 0 |
| VF2468 13 | | | | | | | | | X | X | X | X | 0 | 166914 | | 0 | 148547 | | |
| VF2468 14 | | | | | | | | | X | X | X | X | | | | | | | |
| VF2468 15 | | | | | | | | | X | X | X | X | 0 | 329599 | | 145 | 290700 | 0.050% | 0 |
| VF2468 16 | | | | | | | | | X | X | X | X | 0 | 157651 | | 0 | 136373 | | |
| VF2468 17 | | | | | | | | | X | X | X | X | | | | | | | |
| VF2468 18 | | | | | | | | | X | X | X | X | 0 | 13660 | | 13 | 12386 | 0.10% | 0.00015 |
| VF2468 19 | | | | | | | | | X | X | X | X | 0 | 176808 | | 163 | 191327 | 0.085% | 0 |
| VF2468 20 | | | | | | | | | X | X | X | X | 1 | 286818 | 0.00035% | 3 | 343497 | 0.00087% | 0.20 |
| VF2468 21 | | | | | | | | | X | X | X | X | 0 | 168032 | | 0 | 183289 | | |
| VF2468 22 | | | | | | | | | X | X | X | X | 0 | 86347 | | 0 | 87663 | | |
| VF2468 23 | | | | | | | | | X | X | X | X | 0 | 23198 | | 394 | 34456 | 1.1% | 0 |
| VF2468 24 | | | | | | | | | X | X | X | X | 0 | 57001 | | 283 | 63841 | 0.44% | 0 |
| VF2468 25 | | | | | | | | | X | X | X | X | 0 | 181022 | | 0 | 221989 | | |
| VF2468 26 | | | | | | | | | X | X | X | X | 0 | 132693 | | 0 | 139071 | | |
| VF2468 27 | | | | | | | | | X | X | X | X | 0 | 73084 | | 0 | 100249 | | |
| VF2468 28 | | | | | | | | | X | X | X | X | 0 | 323231 | | 1116 | 353441 | 0.32% | 0 |
| VF2468 29 | | | | | | | | | X | X | X | X | 0 | 156241 | | 439 | 168937 | 0.26% | 0 |
| VF2468 30 | | | | | | | | | X | X | X | X | 0 | 77427 | | 1960 | 92791 | 2.1% | 0 |
| VF2468 31 | | | | | | | | | X | X | X | X | 0 | 34408 | | 114 | 33070 | 0.34% | 0 |

TABLE 7 -continued

Potential VF2468 genomic off-target sites. DNA for 90 out of 97 potential VF2468 genomic target sites were amplified by PCR from cultured K562 cells expressing active VF2468ZFN or from cells containing empty expression vector (SEQ ID NOs: 366-653). Mutation frequency for each site is the percentage of sequences with insertions or deletions (indels) in the sequenced DNA from cultured K562 cells expressing active VF2468.

| Site | | | | | | | | | | | Val1 | Val2 | Pct1 | Val3 | Val4 | Pct2 |
|---|---|---|---|---|---|---|---|---|---|---|---|---|---|---|---|---|
| VF2468 32 | x | x | x | x | x | x | x | x | x | 0 | 19630 | 18 | 17409 | 0.11% | 6.5E-08 |
| VF2468 33 | x | x | x | x | x | x | x | x | x | 0 | 89679 | 2670 | 90901 | 2.8% | 0 |
| VF2468 34 | x | x | x | x | x | x | x | x | x | 0 | 112449 | 231 | 150275 | 0.15% | 0 |
| VF2468 35 | x | x | x | x | x | x | x | x | x | 0 | 418083 | 695 | 532165 | 0.13% | |
| VF2468 36 | x | x | x | x | x | x | x | x | x | 0 | 141739 | 0 | 139368 | | |
| VF2468 37 | x | x | x | x | x | x | x | x | x | 0 | 153897 | 1174 | 178559 | 0.66% | 0 |
| VF2468 38 | x | x | x | x | x | x | x | x | x | 0 | 287706 | 175 | 283788 | 0.062% | 0 |
| VF2468 39 | x | x | x | x | x | x | x | x | x | 0 | 212038 | 0 | 219913 | | |
| VF2468 40 | x | x | x | x | x | x | x | x | x | 0 | 132803 | 0 | 147070 | | |
| VF2468 41 | x | x | x | x | x | x | x | x | x | 0 | 204408 | 0 | 227091 | | |
| VF2468 42 | x | x | x | x | x | x | x | x | x | 1 | 313747 | 0.00032% | 1 | 403382 | 0.00025% | 0.57 |
| VF2468 43 | x | x | x | x | x | x | x | x | x | 1 | 154154 | 0.00065% | 0 | 193644 | | 0.84 |
| VF2468 44 | x | x | x | x | x | x | x | x | x | 0 | | | | | |
| VF2468 45 | x | x | x | x | x | x | x | x | x | 0 | 250890 | 0 | 237104 | | |
| VF2468 46 | x | x | x | x | x | x | x | x | x | 0 | 247702 | 1 | 319493 | 0.00031% | 0.15 |
| VF2468 47 | x | x | x | x | x | x | x | x | x | 0 | 270263 | 1 | 358704 | 0.00028% | 0.15 |
| VF2468 48 | x | x | x | x | x | x | x | x | x | 0 | 103878 | 0 | 176333 | | |
| VF2468 49 | x | x | x | x | x | x | x | x | x | 0 | 542052 | 0 | 708517 | | |
| VF2468 50 | x | x | x | x | x | x | x | x | x | 0 | 177732 | 1 | 212250 | 0.00047% | 0.15 |
| VF2468 51 | x | x | x | x | x | x | x | x | x | 0 | 294783 | 0 | 302167 | | |
| VF2468 52 | x | x | x | x | x | x | x | x | x | 0 | 482765 | 1 | 402831 | 0.00025% | 0.15 |
| VF2468 53 | x | x | x | x | x | x | x | x | x | 0 | 183510 | 1 | 202083 | 0.00049% | 0.15 |
| VF2468 54 | x | x | x | x | x | x | x | x | x | 0 | 88944 | 0 | 105879 | | |
| VF2468 55 | x | x | x | x | x | x | x | x | x | 0 | | | | | |
| VF2468 56 | x | x | x | x | x | x | x | x | x | 0 | 360710 | 0 | 351215 | | |
| VF2468 57 | x | x | x | x | x | x | x | x | x | 0 | 140671 | 0 | 157922 | | |
| VF2468 58 | x | x | x | x | x | x | x | x | x | 0 | 196624 | 0 | 209781 | | |
| VF2468 59 | x | x | x | x | x | x | x | x | x | 0 | 223714 | 0 | 246196 | | |
| VF2468 60 | x | x | x | x | x | x | x | x | x | 0 | 302495 | 0 | 383303 | | |
| VF2468 61 | x | x | x | x | x | x | x | x | x | 0 | 84153 | 0 | 113996 | | |
| VF2468 62 | x | x | x | x | x | x | x | x | x | 0 | 191187 | 138 | 212085 | 0.065% | 0 |
| VF2468 63 | x | x | x | x | x | x | x | x | x | 1 | 372808 | 0.00027% | 2 | 438355 | 0.00046% | 0.33 |
| VF2468 64 | x | x | x | x | x | x | x | x | x | 0 | 167551 | 0 | 185442 | | |
| VF2468 65 | x | x | x | x | x | x | x | x | x | 0 | | | | | |
| VF2468 66 | x | x | x | x | x | x | x | x | x | 4 | 545543 | 0.00073% | 3756 | 587393 | 0.64% | 0 |
| VF2468 67 | x | x | x | x | x | x | x | x | x | 0 | 171147 | 0 | 203860 | | |
| VF2468 68 | x | x | x | x | x | x | x | x | x | 0 | 89976 | 391 | 137236 | 0.28% | 0 |
| VF2468 69 | x | x | x | x | x | x | x | x | x | 0 | 38342 | 153 | 50273 | 0.30% | 0 |
| VF2468 70 | x | x | x | x | x | x | x | x | x | 0 | 252020 | 0 | 277262 | | |
| VF2468 71 | x | x | x | x | x | x | x | x | x | 0 | 178243 | 0 | 255921 | | |
| VF2468 72 | x | x | x | x | x | x | x | x | x | 0 | 138844 | 94 | 221676 | 0.042% | 0 |
| VF2468 73 | x | x | x | x | x | x | x | x | x | 0 | 182565 | 2808 | 212729 | 1.3% | 0 |
| VF2468 74 | x | x | x | x | x | x | x | x | x | 1 | 103739 | 0.00033% | 1 | 130605 | 0.00077% | 0.15 |
| VF2468 75 | x | x | x | x | x | x | x | x | x | 0 | 300572 | 0 | 355283 | | 0.84 |
| VF2468 76 | x | x | x | x | x | x | x | x | x | 0 | 185773 | 0 | 185094 | | |
| VF2468 77 | x | x | x | x | x | x | x | x | x | 1 | 131239 | 0.00076% | 0 | 133319 | 0.15% | |
| VF2468 78 | x | x | x | x | x | x | x | x | x | 0 | 212883 | 243 | 157434 | 0.15% | 0 |

TABLE 7 -continued

Potential VF2468 genomic off-target sites. DNA for 90 out of 97 potential VF2468 genomic target sites were amplified by PCR from cultured K562 cells expressing active VF2468ZFN or from cells containing empty expression vector (SEQ ID NOs: 366-653). Mutation frequency for each site is the percentage of sequences with insertions or deletions (indels) in the sequenced DNA from cultured K562 cells expressing active VF2468.

| Site | (+) | spacer | (−) | indels (untreated) | total (untreated) | % (untreated) | indels (treated) | total (treated) | % (treated) | p-value |
|---|---|---|---|---|---|---|---|---|---|---|
| VF2468 79 | x | x | x | 0 | 112164 |  | 34 | 116695 | 0.029% | 2.7E-09 |
| VF2468 80 | x | x | x | 0 | 195577 |  | 77 | 188335 | 0.041% | 0 |
| VF2468 81 | x | x | x | 1 | 151845 |  | 0 | 144107 |  | 0.84 |
| VF2468 82 | x | x | x |  |  | 0.00066% |  |  |  |  |
| VF2468 83 | x | x | x | 0 | 240952 |  | 1 | 233954 | 0.00043% | 0.16 |
| VF2468 84 | x | x | x | 0 | 191108 |  | 0 | 167663 |  |  |
| VF2468 85 | x | x | x | 0 | 405543 |  | 209 | 355997 | 0.059% | 0 |
| VF2468 86 | x | x | x | 0 | 212942 |  | 393 | 247078 | 0.16% | 0 |
| VF2468 87 | x | x | x | 0 | 4171 |  | 18 | 3024 | 0.60% | 1.0E-05 |
| VF2468 88 | x | x | x | 0 | 115967 |  | 59 | 115268 | 0.051% | 7.8E-15 |
| VF2468 89 | x | x | x | 1 | 171873 | 0.00058% | 0 | 207336 |  | 0.84 |
| VF2468 90 | x | x | x | 2 | 193447 | 0.0010% | 1 | 196665 | 0.00051% | 0.72 |
| VF2468 91 | x | x | x | 0 | 107549 |  | 0 | 109933 |  |  |
| VF2468 92 | x | x | x | 0 | 71298 |  | 0 | 77229 |  |  |
| VF2468 93 | x | x | x | 0 | 99279 |  | 0 | 121284 |  |  |
| VF2468 94 | x | x | x | 0 | 152251 |  | 0 | 206428 |  |  |
| VF2468 95 | x | x | x | 0 | 91338 |  | 0 | 134004 |  |  |
| VF2468 96 | x | x | x | 0 | 245402 |  | 0 | 345728 |  |  |
| VF2468 97 | x | x | x | 0 | 76762 |  | 0 | 92742 |  |  |

Bolded red sites have significantly enriched indel percentages in the active nuclease sample compared to cells not expressing nuclease.
The sequences of the sites are listed as 5' (+) halfsite (SEQ ID NOs: 366-461)/spacer/(−) half-site 3' (SEQ ID NOs: 462-557) (Full sequences are SEQ ID NOs: 558-653), therefore the (+) half-site is listed in the reverse sense as it is in the sequence profiles.
Seven sites were not tested since they did not yield site-specific PCR amplification products.
Indels and totals are not shown for those sites that were not tested.
P-values shown are for the one-sided alternative hypothesis that the indel frequency is greater for active ZFN treated cells than for cells not expressing ZFN.

TABLE 8

Oligonucleotides used in this study. Oligonucleotides "[ZFN] [#] fwd/rev" were ordered from Invitrogen. All other oligonucleotides were ordered from Integrated DNA Technologies. 'N' refers to machine mixed incorporation of 'A', 'C', 'G', or 'T.' An asterisk indicates that the preceding nucleotide was incorporated as a mixture containing 79 mol % of that nucleotide and 7 mol % each of the other canonical nucleotides. "/5Phos/" denotes a 5' phosphate group installed during synthesis. Sequences are listed as SEQ ID NOs: 654-924 descending.

| oligonucleotide name | oligonucleotide sequence (5'->3') | | |
|---|---|---|---|
| N5-PvuI | NNNNNCGATCGTTGGGAACCGGA | | |
| CCR5-224-N4 | NG*T*C*A*T*C*C*T*C*A*T*C*NNNNA*A*A*C*T*G*C*A*A*A*A*G*NCAGTGGAACGAA | | |
| CCR5-224-IN5 | NG*T*C*A*T*C*C*T*C*A*T*C*NNNNNA*A*A*C*T*G*C*A*A*A*A*G*NCAGTGGAACGAAAACTCACG | | |
| CGR5-224-N6 | NG*T*C*A*T*C*C*T*C*A*T*C*NNNNNNA*A*A*C*T*G*C*A*A*A*A*G*NCAGTGGAACGAAAACTCACG | | |
| CCR5-224-N7 | NG*T*C*A*T*C*C*T*C*A*T*C*NNNNNNNA*A*A*C*T*G*C*A*A*A*A*G*NCAGTGGAACGAAAACTCACG | | |
| VF2468-N4 | NA*G*C*A*G*C*G*T*C*NNNNG*A*G*T*G*A*G*G*A*NCAGTGGAACGAAAACTCACG | | |
| VF2468-N5 | NA*G*C*A*G*C*G*T*C*NNNNNG*A*G*T*G*A*G*G*A*NCAGTGGAACGAAAACTCACG | | |
| VF2468-N6 | NA*G*C*A*G*C*G*T*C*NNNNNNG*A*G*T*G*A*G*G*A*NCAGTGGAACGAAAACTCACG | | |
| VF2468-N7 | NA*G*C*A*G*C*G*T*C*NNNNNNNG*A*G*T*G*A*G*G*A*NCAGTGGAACGAAAACTCACG | | |
| test fwd | GCGACACGGAAATGTTGAATACTCAT | | |
| test rev | CAGCGAGTCAGTGAGCGA | | |
| adapter1 | ACACTCTTTCCCTACACGACGCTCTTCCGATCTT | | |
| adapter1(AAT) | ACACTCTTTCCCTACACGACGCTCTTCCGATCTAATT | | |
| adapter1(ATA) | ACACTCTTTCCCTACACGACGCTCTTCCGATCTATAT | | |
| adapter1(TAA) | ACACTCTTTCCCTACACGACGCTCTTCCGATCTTAAT | | |
| adapter1(CAC) | ACACTCTTTCCCTACACGACGCTCTTCCGATCTCACT | | |
| adapter2 | /5Phos/AGATCGGAAGAGCGGTTCAGCAGGAATGCCGAG | | |
| adapter2(AAT) | /5Phos/ATTAGATCGGAAGAGCGGTTCAGCAGGAATGCCGAG | | |
| adapter2(ATA) | /5Phos/TATAGATCGGAAGAGCGGTTCAGCAGGAATGCCGAG | | |
| adapter2(TAA) | /5Phos/TTAAGATCGGAAGAGCGGTTCAGCAGGAATGGCGAG | | |
| adapter2(CAC) | /5Phos/GTGAGATCGGAAGAGCGGTTCAGCAGGAATGCCGAG | | |
| PE1 | CAAGCAGAAGACGGCATACGAGATCGGTCTCGGCATTCCTGCTGAACCGCTCTTCCGATC | | |
| PE2 | AATGATACGGCGACCACCGAGATCTACACTCTTTCCCTACACGACGCTCTTCCGATCT | | |
| CCR5-224 1 fwd | ATACATCGGAGCCCTGCCAA | CCR5-224 1 rev | GGAAAAACAGGTCAGAGATGGC |
| CCR5-224 2 fwd | TCCTGCCTCCGCTCTACTCG | CCR5-224 2 rev | ACCCCAAAGGTGACCGTCCT |
| CCR5-224 3 fwd | TCCCSCGTTTTCCCCTTGAC | CCR5-224 3 rev | GTCCCTCACGACGACCGACT |
| CCR5-224 4 fwd | GCACTGCCCCAGAAATATTGGTT | CCR5-224 4 rev | TGGTTTGTTGGGGGATCAGG |
| CCR5-224 5 fwd | ATGCCACCCCTGCCAGATAA | CCR5-224 5 rev | GCCTACCTCAATGCAGGCAAA |
| CCR5-224 6 fwd | TCTGCTTCTGCCCTTGTGGA | CCR5-224 6 rev | GGAGGATCGCCAAGACCTGA |
| CCR5-224 7 fwd | CCCCAGTGCTTAAGATAGTTCTTGG | CCR5-224 7 rev | ACTCCCAGACAAACCCCGCT |
| CCR5-224 8 fwd | GGCACCAGAACTTACTCACTGCC | CCR5-224 8 rev | TGTGAAGGCCCAAAACCCTG |
| CCR5-224 9 fwd | GTTTTGGGGGTCATGGCAAA | CCR5-224 9 rev | TGGGCAGGCCCTAGGTCCTTT |
| CCR5-224 10 fwd | TTTCCCTGGTGATGCACTCCT | CCR5-224 10 rev | TGATGAGTAACTTGGGCGAAAA |
| CCR5-224 11 fwd | TTGGGGGAATGAGATTGGGA | CCR5-224 11 rev | GGAAAATCCAGCAAGGTGAAA |

TABLE 8-continued

Oligonucleotides used in this study. Oligonucleotides "[ZFN] [#] fwd/rev" were ordered from Invitrogen. All other oligonucleotides were ordered from Integrated DNA Technologies. 'N' refers to machine mixed incorporation of 'A', 'C', 'G', or 'T.' An asterisk indicates that the preceding nucleotide was incorporated as a mixture containing 79 mol % of that nucleotide and 7 mol % each of the other canonical nucleotides. "/5Phos/" denotes a 5' phosphate group installed during synthesis. Sequences are listed as SEQ ID NOs: 654-924 descending.

| oligonucleotide name | oligonucleotide sequence (5'->3') | | |
|---|---|---|---|
| CCR5-224 13 fwd | CCTTCCCATGGTCACAGAGG | CCR5-224 13 rev | CAACTCTCTAACAGCAAAGTGGCA |
| CCR5-224 14 fwd | TCCTCCCGTTGAGGAAGCAC | CCR5-224 14 rev | GCCTCAAAAGCATAAACAGCA |
| CCR5-224 15 fwd | CAGACCGCTGGTGCTGAGAC | CCR5-224 15 rev | AGGGCGGACTCATTGCTTTG |
| CCR5-224 16 fwd | TGGGTTCCTCGGGTTCTCTG | CCR5-224 16 rev | GAAACCAGAAGTTCACAACAATGCTT |
| CCR5-224 17 fwd | AGGCATAAGCCACTGCACCC | CCR5-224 17 rev | TGGCAATGCCTAATCAGACCA |
| CCR5-224 18 fwd | GAGGATATTTTATTGCTGGCTCTTGC | CCR5-224 18 rev | GAGTTTGGGGAAAAGCCACTT |
| CCR5-224 20 fwd | GCTGAGGCCCACCTTTCCTT | CCR5-224 28 rev | TGCTCTGCCAACTGTGAGGG |
| CCR5-224 21 fwd | TGTTTTGGGTGCATGTGGGT | CCR5-224 21 rev | TCCAGGGAGTGAGGTGAAGACA |
| CCR5-224 22 fwd | CTGGGTCAGCTGGGCCATAC | CCR5-224 22 rev | TCACATCTCCGCCTCACGAT |
| CCR5-224 23 fwd | CCAGCCTTGGAAAAATGGACA | CCR5-224 23 rev | CTGACACAGTGGCCAGCAGC |
| CCR5-224 24 fwd | CATGGATGTAATGGGTTGTATCTGC | CCR5-224 24 rev | GAGGGCAGAAGGGGGTGAGT |
| CCR5-224 25 fwd | AGGATGCATTGTCCCCCAGA | CCR5-224 25 rev | TGGAGTGACATGTATGAAGCCA |
| CCR5-224 26 fwd | CGTTGGCTTGCAGAAGGGAC | CCR5-224 26 rev | TGAACCCCGGATTTTTCAACC |
| CCR5-224 27 fwd | TGACCCAACTAAGTCTGTGACCC | CCR5-224 27 rev | TTGGGAAAGCTTTGATGCTGG |
| CCR5-224 28 fwd | TGGGTTGTGTTTTTGACTGACAGA | CCR5-224 28 rev | CCCTAGGGGTCACTGGAGCA |
| CCR5-224 29 fwd | CACCCCCATGCAGGAAAATG | CCR5-224 29 rev | TTGGCTGCTGGCATTTGGTA |
| CCR5-224 33 fwd | GGCCATTGGTTCTGGAGGAA | CCR5-224 30 rev | TCCGTTGCTTCATCCTTCCAA |
| CCR5-224 31 fwd | AGTCAGCAATGCCCCAGAGC | CCR5-224 31 rev | TGGAGAGGGTTTACTTTCCCAGA |
| CCR5-224 32 fwd | CCTGGGAGGGTGACTAGTTGGA | CCR5-224 32 rev | GCTCAGGGCCTGGCTTACAG |
| CCR5-224 33 fwd | TGGCAATTAGGATGTGCCAG | CCR5-224 33 rev | TCCACTCACAAATTTACCTTTCCAC |
| CCR5-224 34 fwd | TGCGCCACATCTTCACCAGA | CCR5-224 34 rev | CCGCATAAAGGAGGTGTCGG |
| CCR5-224 36 fwd | GTTGCATCTGCGGTCTTCCA | CCR5-224 36 rev | GGAGAGTCTTCCGCCTGTGTT |
| CCR5-224 37 fwd | TAGTGGCCCCAACATGCAAA | CCR5-224 37 rev | GCACATATCATGCACTGTGACTGTAA |
| VF2468 1 fwd | CCTTTCCAAAGCCCATTCCC | VF2468 1 rev | CAACCCCACACGCACACAC |
| VF2468 2 fwd | TTCACTGCCTTCAGGCCTCC | VF2468 2 rev | AATGGCCAGAAAATTCCCAAA |
| VF2468 3 fwd | CACAGGGACCCAGGACTGCT | VF2468 3 rev | TGACTGGAACCGTGCAGCAT |
| VF2468 4 fwd | GCACCAGGCTTCTCTGCCAT | VF2468 4 rev | TCGGGGGTCCATGGTATTTG |
| VF2468 5 fwd | CCAAGGCGAGGACATTGAGG | VF2468 5 rev | CCCCAAGTCAGACCCTGCAT |
| VF2468 7 fwd | ACCATAGTCCAGCGGGGTCA | VF2468 7 rev | TTCTCCCCAAGGAAGGCTGA |
| VF2468 8 fwd | AGAAAGGGTGGTCGGGGAAG | VF2468 8 rev | GCCACCATGCCCAGTCTACA |
| VF2468 9 fwd | TTCCCATGGGGTCTCAGCTC | VF2468 9 rev | ATGGCCTTCCCCAACTGTGA |
| VF2468 10 fwd | CAGCAAGGATGCCGTTCACC | VF2468 10 rev | CGTTGTGATTGAGGAGACGAGG |
| VF2468 11 fwd | GGCTTGAGCTGGAAGGACCA | VF2468 11 rev | TGGAGCAACTGAACATGTTGGG |
| VF2468 12 fwd | AACCGAGTTTGCACCGTCGT | VF2468 12 rev | CATAACCACCAGGACATCCGC |

TABLE 8-continued

Oligonucleotides used in this study. Oligonucleotides "[ZFN] [#] fwd/rev" were ordered from Invitrogen. All other oligonucleotides were ordered from Integrated DNA Technologies. 'N' refers to machine mixed incorporation of 'A', 'C', 'G', or 'T.' An asterisk indicates that the preceding nucleotide was incorporated as a mixture containing 79 mol % of that nucleotide and 7 mol % each of the other canonical nucleotides. "/5Phos/" denotes a 5' phosphate group installed during synthesis. Sequences are listed as SEQ ID NOs: 654-924 descending.

| oligonucleotide name | oligonucleotide sequence (5'->3') | | |
|---|---|---|---|
| VF2468 13 fwd | TATCCTCCCCTTTCCCCTGA | VF2468 13 rev | TGTTGCCAGAAGTATCAGGTCCC |
| VF2468 15 fwd | AGAACCCGGAATCCCTTTGC | VF2468 15 rev | GCAGAGAAGGCAGCAGCACA |
| VF2468 16 fwd | GGTCTCTGCCATGCCCAACT | VF2468 16 rev | TGGAGGAAGCAGGAAAGGCAT |
| VF2468 18 fwd | CCCCTTGGGATCCTTGTCCT | VF2468 18 rev | TCAACAGGCAGGTACAGGGC |
| VF2468 19 fwd | CTAGGCCTGTGGGCTGAGGA | VF2468 19 rev | CAAATGTTGGGGTGTGGGTG |
| VF2468 20 fwd | TACCTGAAACCCCTGGCCCT | VF2468 20 rev | CAAGCTGGATGTGGATGCAGAG |
| VF2468 21 fwd | CGGGGGCCTGACATTAGTGA | VF2468 21 rev | GCCTGAAGATGCATTTGCCC |
| VF2468 22 fwd | TGCATTGGCTCAAGAATTGGG | VF2468 22 rev | TCACACAGTGGTAATGGACAGGAA |
| VF2468 23 fwd | GCGCTCCCTGTGTTCAGTACC | VF2468 23 rev | GCGCAAGTTCCCCTTTCTGA |
| VF2468 24 fwd | TGTTTGGGTTATGGGGCAG | VF2468 24 rev | TCCAGCATCTGCTCCTGGTG |
| VF2468 25 fwd | AAGGAGACTTCTCAGGCCCCA | VF2468 25 rev | TGAAGGGAAGCCACAGCTCC |
| VF2468 26 fwd | CTTGGGGCAGACAGCATCT | VF2468 26 rev | GCCATGGGATGGCAGTTAGG |
| VF2468 27 fwd | TGGCCTCAAGCAATCCTCCT | VF2468 27 rev | TTCCATGGCAGTGAAGGGTG |
| VF2468 28 fwd | CCAAAGAGCCTGGAGGAGCA | VF2468 28 rev | CAGAGGGTGTGGTGGTGTCG |
| VF2468 29 fwd | CCAGCCTGTGAAGCTGGAAGTAA | VF2468 29 rev | CCAGTGGGCTGAGTGGATGA |
| VF2468 30 fwd | CATCTGAATGCCCATGCTGC | VF2468 30 rev | CCGCCACACCCATTCCTC |
| VF2468 31 fwd | CCTCAAAGAAACGGCTGCTGA | VF2468 31 rev | GCCGCTCGAAAAGAGGGAAT |
| VF2468 32 fwd | CGGGCTCTCCTCCTCAAAGA | VF2468 32 rev | GGCCCCTTGAAAAGAGGGAA |
| VF2468 33 fwd | GGAATCGCATGACCTGAGGC | VF2468 33 rev | CGGGCTCTCCTCCTCAAAGA |
| VF2468 34 fwd | CCCGCCAGACACATTCCTCT | VF2468 34 rev | CATCTGAATGCCCATGCTGC |
| VF2468 35 fwd | CCGCACCTTTTTCCTATGTGGT | VF2468 35 rev | TCAGATGTGGTAGGAGACAGATGAC |
| VF2468 36 fwd | GGTACATGGGCCGCACTTTC | VF2468 36 rev | GGACAGCTGGGAATTGGTGG |
| VF2468 37 fwd | TTACCTGCTGGCAGGCAA | VF2468 37 rev | GCTGGTGTGAGCAAGAGGCA |
| VF2468 38 fwd | TGGCCAAGCCTGCCTAACTC | VF2468 38 rev | TGATCAGTTAGCCCTGGGGG |
| VF2468 39 fwd | CCCCTTCTGCTCCTGCTTCA | VF2468 39 rev | CCTTCCTTGCAGCTCAAACCC |
| VF2468 40 fwd | TGATTTTCAGCGTGGAGGGC | VF2468 40 rev | ACGGCAAAGCCAGAGCAAAG |
| VF2468 41 fwd | AAGCTGGCAGCCACTGTTCA | VF2468 41 rev | TCTCAGGGCTTCTGTGTGCG |
| VF2468 42 fwd | TCGATTCTCCATACACCATCAAT | VF2468 42 rev | GCAACCACTCCCAACAGGG |
| VF2468 43 fwd | AGGTCCTGGCATTGTCTGGG | VF2468 43 rev | TGGTTGCCTGTTTCACACCC |
| VF2468 45 fwd | CTGGGAGGCAGCCAGTCAAG | VF2468 45 rev | GCCCTGTAAGCTGAAGCTGGA |
| VF2468 46 fwd | CAGGTGTGCATTTTGTTGCCA | VF2468 46 rev | GCCTGCCAGGTATTTCCTGTGT |
| VF2468 47 fwd | TGGGCGTGGTCATGTGAAAA | VF2468 47 few | AACTGCAAGTGGGCTCCCAG |
| VF2468 48 fwd | TTGATAAGGGCGGTGCCACT | VF2468 48 rev | TAGAGGGAGGTGCTTGCCCA |
| VF2468 49 fwd | CATCCCCTTGACCAACAGGC | VF2468 49 rev | GCTTGGGCACTGATCCTGCT |

TABLE 8-continued

Oligonucleotides used in this study. Oligonucleotides "[ZFN] [#] fwd/rev" were ordered from Invitrogen. All other oligonucleotides were ordered from Integrated DNA Technologies. 'N' refers to machine mixed incorporation of 'A', 'C', 'G', or 'T.' An asterisk indicates that the preceding nucleotide was incorporated as a mixture containing 79 mol % of that nucleotide and 7 mol % each of the other canonical nucleotides. "/5Phos/" denotes a 5' phosphate group installed during synthesis. Sequences are listed as SEQ ID NOs: 654-924 descending.

| oligonucleotide name | oligonucleotide sequence (5'->3') | | |
|---|---|---|---|
| VF2468 50 fwd | ACTGCCAATGGACCCTCTCG | VF2468 50 rev | GAGTTGCCCAGGTCAGCCAT |
| VF2468 51 fwd | GGGGAGCTAGAATGGTGGGC | VF2468 51 rev | CAAGGTACACAGGTGACCAGG |
| VF2468 52 fwd | CCCATGCTGGTCCTGCTGTT | VF2468 52 rev | GGAGGCTCAGCGGAGAGGAT |
| VF2468 53 fwd | GGGGTCACCAGGGAAGGTTT | VF2468 53 rev | AGTTGCGGGAGGTGCTACA |
| VF2468 54 fwd | TGCCCAGAGACCTTCCAAGC | VF2468 54 rev | TGGCCAAGGCCTCTCTAAGC |
| VF2468 56 fwd | GCCAATGTGCAATCGAGACG | VF2468 55 rev | TGCATGCCTCTGACTGATGCT |
| VF2468 57 fwd | TGACTTGAACTGGGTCCCCC | VF2468 57 rev | CTGGGGCTACAGCCCTCCTT |
| VF2468 58 fwd | CCCAATCCAGACACCACACG | VF2468 58 rev | TGCAGATTTTAGGGGTTGCCA |
| VF2468 59 fwd | GGTGAGGAAGGATGGGGGTT | VF2468 59 rev | GTAGGCTCTGCCACGCCAGT |
| VF2468 60 fwd | TGCCCATGTTGTTGCTCCAC | VF2468 60 rev | GACAAGTTAGACCATCCTAGCCCTCA |
| VF2468 61 fwd | TCACAGCTCCCCTTTCTCGG | VF2468 61 rev | TGTGCCTCCACTGACGCATT |
| VF2468 62 fwd | CCTAGGCACAGTGGGGGATG | VF2468 62 rev | GGGCTGACACACTGAGGGCT |
| VF2468 63 fwd | CCATGAGCACAATTGCCAAAA | VF2468 63 rev | TGAGTTATTTCGAAAGAGGAAACAGTG |
| VF2468 64 fwd | CTGCCAAGAACAGGAGGGGA | VF2468 64 rev | AGCCCATCTACCATCCAGCG |
| VF2468 66 fwd | ATCGGGGCAGGGCTAGAGTG | VF2468 66 rev | CCCCTGGCATTCCCTACACA |
| VF2468 67 fwd | GCCGTTAGTGCATTTGCCTG | VF2468 67 rev | TCCCTTTCAACCCCTGTAGTGC |
| VF2468 68 fwd | GTTCCTCCCAGAGTGGGGCT | VF2468 68 rev | ACTGAGGGAGGCAGCACTGG |
| VF2468 69 fwd | AGGCCTGGCGGTAACCTTG | VF2468 69 rev | AAGCTCCAGCCCTGTACCCC |
| VF2468 70 fwd | GGGATCCTACAGGATGGGACAA | VF2468 70 rev | CAGCCCAGGACAAGGGTAGC |
| VF2468 71 fwd | GCGACCAAATGTCCACTGGTT | VF2468 71 rev | TTCCGCAAGCAGTCCAGCTC |
| VF2468 72 fwd | GCACCAGCCTCTTCGATGGT | VF2468 72 rev | CGTTTGGCAGACTGTGGCGT |
| VF2468 73 fwd | AATGGGGCAAAAGGCAAGAAA | VF2468 73 rev | CAGACCTCGTGGTGCATGTG |
| VF2468 74 fwd | TGGCGAGATAGGCTCTGCTACA | VF2468 74 rev | TGGACAGGGAATTACTGAGACCAG |
| VF2468 75 fwd | TGTGGGCATGAGACCACAGG | VF2468 75 rev | TTTGACTCCCCCGCATTGTT |
| VF2468 76 fwd | TCCTATTTTCAGATGCACTCGAACC | VF2468 76 rev | GTGCTCACTGAAGCCCACCA |
| VF2468 77 fwd | GGACCTTCTTGCCCTCATGATTC | VF2468 77 rev | GGGAACTGTGCCTTTGCGTC |
| VF2468 78 fwd | CCTTGCAAAGGCTTGCCTAAA | VF2468 78 rev | GGCAGGCACCTGTAGTCCCA |
| VF2468 79 fwd | TGGCTTGCAGAGGAGGTGAG | VF2468 79 rev | GAGGGAAGGGTGTTGGCTTG |
| VF2468 80 fwd | GCTTCAGCACATCAGTGGCG | VF2468 80 rev | TTCGCCCAGCTCATCAACAA |
| VF2468 81 fwd | GGTGAGGCCACTGTAAGCCAA | VF2468 81 rev | TGGGCTGCCATGACAAACAG |
| VF2468 83 fwd | GAGTTGAGCTGTCAGCGGGG | VF2468 83 rev | GAAGCCAACTGCCTTGTGAGC |
| VF2468 84 fwd | TGTTTTCTGCAGTTTTGCAGGG | VF2468 84 rev | GGCTCAGGGAGTTTGAGCCA |
| VF2468 85 fwd | GCTCTGGCACCAGGCACACT | VF2468 85 rev | GGGAGAGAACCATGAATTTCCCA |
| VF2468 86 fwd | GCCAAACCGTTTCCAGGGAG | VF2468 86 rev | CCCACCCTATGCACAGAGCC |

TABLE 8-continued

Oligonucleotides used in this study. Oligonucleotides "[ZFN] [#] fwd/rev" were ordered from Invitrogen. All other oligonucleotides were ordered from Integrated DNA Technologies. 'N' refers to machine mixed incorporation of 'A', 'C', 'G', or 'T.' An asterisk indicates that the preceding nucleotide was incorporated as a mixture containing 79 mol % of that nucleotide and 7 mol % each of the other canonical nucleotides. "/5Phos/" denotes a 5' phosphate group installed during synthesis. Sequences are listed as SEQ ID NOs: 654-924 descending.

| oligonucleotide name | oligonucleotide sequence (5'->3') | | |
|---|---|---|---|
| VF2468 87 fwd | CCTCAGCCAGTTGGAATCGG | VF2468 87 rev | CAACGGTTTAGTTTAGTTCCGGTTT |
| VF2468 88 fwd | TGGGTGGTGAAAATGGGGTT | VF2468 88 rev | GGTGGGGTATGCACTGGTCA |
| VF2468 89 fwd | GGAATGTGTGGAACAATTTCTTT | VF2468 89 rev | TTGCTTGCAGGGTGTGGAAA |
| VF2468 90 fwd | CCACAAGGGTCATCTGGGGA | VF2468 90 rev | GGGAGGCATCATCCACTGAG |
| VF2468 91 fwd | CCTGGAGTGGTTTGGCTTCG | VF2468 91 rev | TGGAGCCCTGGAGTTCTTGG |
| VF2468 92 fwd | GGCTCCTGGGGTCATTTTCC | VF2468 92 rev | TGTGCTCCATCCTCCTCCCT |
| VF2468 93 fwd | GTGTGTTTCCGCACACCCTG | VF2468 93 rev | GCTCTTGGCTTCCCAACCCT |
| VF2468 94 fwd | CCATCGCCGTGTCTGAGTGT | VF2468 94 rev | CAGCAGGAACATCATCCCCC |
| VF2468 95 fwd | AGGCAATGGCACCAAAATGG | VF2468 95 rev | GCAGCCTTCACCATACCTGTGA |
| VF2468 96 fwd | TTTTGACTTTGAGAACCCCCTGA | VF2468 96 rev | CCTTGTCCTTTCTCAGTTAGACACA |
| VF2468 97 fwd | GCTGAGTGCCAAAGCTCAGGA | VF2468 97 rev | GGCAACACAGCAAGACCCCT |

VF2468 Data

Potential VF2468 genomic off-target sites. The human genome was searched for DNA sequences surviving in vitro selection for VF2468 cleavage. Sites marked with an 'X' were found in the in vitro selection dataset. 'T' refers to the total number of mutations in the site, and '(+)' and '(−)' to the number of mutations in the (+) and (−) half-sites, respectively. The sequences of the sites are listed as they appear in the genome, therefore the (−) half-site is listed in the reverse sense as it is in the sequence profiles. Sequence (+) half-sites are SEQ ID NOs:925-3538 descending; sequence (−) half-sites are SEQ ID NOs:3539-6152 descending; full sequences with spacers are SEQ ID NOs: 6153-8766 descending.

| # of mutations | | | | | | | VF2468 concentration | | | |
|---|---|---|---|---|---|---|---|---|---|---|
| T | (−) | (+) | (−) site | spacer | (+) site | | 4 nM | 2 nM | 1 nM | 0.5 nM |
| 2 | 1 | 1 | AGCAGCTTC | CTTTT | GAGTGAGAA | | X | X | X | X |
| 2 | 1 | 1 | AGCATCGTC | ATCAGA | CAGTGAGGA | | X | X | X | X |
| 2 | 1 | 1 | AGCAACGTC | GTAGT | GATTGAGGA | | X | X | X | X |
| 2 | 2 | 0 | AGCTGGGTC | ATGAG | GAGTGAGGA | | X | X | X | X |
| 2 | 2 | 0 | AGCTGGGTC | ATGAG | GAGTGAGGA | | X | X | X | X |
| 2 | 2 | 0 | AGCAACTTC | TGGAAA | GAGTGAGGA | | X | X | X | X |
| 2 | 2 | 0 | AGCTGAGTC | TTAAG | GAGTGAGGA | | X | X | X | X |
| 2 | 2 | 0 | TCCAGCGTC | CTCCCA | GAGTGAGGA | | X | X | X | X |

| # of mutations | | | | | | | VF2468 concentration | | | |
|---|---|---|---|---|---|---|---|---|---|---|
| T | (−) | (+) | (−) site | spacer | (+) site | | 4 nM | 2 nM | 1 nM | 0.5 nM |
| 2 | 2 | 0 | TGCAGCGTT | AAAATA | GAGTGAGGA | | X | X | X | X |
| 2 | 2 | 0 | AGCACCTTC | AATTG | GAGTGAGGA | | X | X | X | X |
| 2 | 2 | 0 | TGCAGCGGC | GTAGGG | GAGTGAGGA | | X | X | X | X |
| 2 | 2 | 0 | AGCAGGGTT | CTTCAA | GAGTGAGGA | | X | X | X | X |
| 2 | 2 | 0 | AGCAGCATA | GATATG | GAGTGAGGA | | X | X | X | X |
| 2 | 2 | 0 | AACAGCTTC | TCTGAG | GAGTGAGGA | | X | X | X | X |
| 2 | 2 | 0 | TGCAGGGTC | GGGCAG | GAGTGAGGA | | X | X | X | X |
| 2 | 2 | 0 | AGCAAAGTC | AAACA | GAGTGAGGA | | X | X | X | X |
| 2 | 2 | 0 | AACAGCTTC | TCGGGA | GAGTGAGGA | | X | X | X | X |
| 2 | 2 | 0 | AGTAGCGGC | AAATT | GAGTGAGGA | | X | X | X | X |
| 2 | 2 | 0 | AGCTGAGTC | CTAAA | GAGTGAGGA | | X | X | X | X |
| 2 | 2 | 0 | AGCAGCGAG | AAAGA | GAGTGAGGA | | X | X | X | X |
| 2 | 2 | 0 | TGCAGTGTC | CACAA | GAGTGAGGA | | X | X | X | X |
| 2 | 2 | 0 | AGCAGCATA | ATAGCA | GAGTGAGGA | | X | X | X | X |
| 2 | 2 | 0 | AGCAGCATA | TCAGG | GAGTGAGGA | | X | X | X | X |
| 2 | 2 | 0 | AGCAGCGGT | CTTAG | GAGTGAGGA | | X | X | X | X |
| 2 | 2 | 0 | AACAGCTTC | ATCTCG | GAGTGAGGA | | X | X | X | X |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 2 | 2 | 0 | GGCAGAGTC | CTAGA | GAGTGAGGA | X | X | X | X |
| 2 | 2 | 0 | AGCTGTGTC | TTGGA | GAGTGAGGA | X | X | X | X |
| 2 | 2 | 0 | AGTGGCGTC | CCAGT | GAGTGAGGA | X | X | X | X |
| 2 | 2 | 0 | AGCTGTGTC | CACAG | GAGTGAGGA | X | X | X | X |
| 3 | 1 | 2 | AGCAGCGGC | TTAAGG | GGGTGAGGT | X | X | X | X |
| 3 | 1 | 2 | AGCAACGTC | TAACCC | GAGTGTTGA | X | X | X | X |
| 3 | 1 | 2 | AGCACCGTC | CCCCT | CAGTGAGGC | X | X | X | X |
| 3 | 1 | 2 | AGCAGCGGC | GGCTG | CAGTGAGGC | X | X | X | X |
| 3 | 1 | 2 | AGCAGTGTC | TAAAAG | GAGTGAGAT | X | X | X | X |
| 3 | 1 | 2 | AGCAACGTC | CATAGT | GTGTGAGAA | X | X | X | X |
| 3 | 2 | 1 | AGAAACGTC | GTGGAG | GAGTGAGGG | X | X | X | X |
| 3 | 2 | 1 | AGCATAGTC | TAGGCC | GAGTGAGGC | X | X | X | X |
| 3 | 2 | 1 | AGCAACTTC | ATCTT | GAGTGAGGG | X | X | X | X |
| 3 | 2 | 1 | AGCAGGGTG | GCGTG | GAGTGAGGC | X | X | X | X |
| 3 | 2 | 1 | AGCACGGTC | ATGAT | GAGTGAGGC | X | X | X | X |
| 3 | 2 | 1 | AGCATTGTC | TCCTG | GAGTGAGGG | X | X | X | X |
| 3 | 2 | 1 | AGCACCGTG | GCTTC | GAGTGAGGC | X | X | X | X |
| 3 | 2 | 1 | AGCAACTTC | CTGGC | GAGTGAGGG | X | X | X | X |
| 3 | 2 | 1 | AGCAACATC | TGGTTG | GAGTGAGGG | X | X | X | X |
| 3 | 2 | 1 | GGCAGCGGC | CGCTGT | GAGTGAGGT | X | X | X | X |
| 3 | 2 | 1 | AGCATTGTC | TCATGT | GAGTGAGGT | X | X | X | X |
| 3 | 2 | 1 | AGCAGCAGC | TAGGG | GAGTGAGGG | X | X | X | X |
| 3 | 2 | 1 | AGCAGCAGC | CCACAG | GAGTGAGGG | X | X | X | X |
| 3 | 2 | 1 | ATCAGAGTC | TCTGG | GAGTGAGGC | X | X | X | X |
| 3 | 2 | 1 | ATCAGTGTC | CCTCAG | GAGTGAGGC | X | X | X | X |
| 3 | 2 | 1 | AGCAACATC | ATCTT | GAGTGAGGG | X | X | X | X |
| 3 | 2 | 1 | AGCATGGTC | CCAAG | GAGTGAGGG | X | X | X | X |
| 3 | 2 | 1 | AGCAAAGTC | TGTACT | GAGTGAGGG | X | X | X | X |
| 3 | 2 | 1 | AGCAGCTCC | TCTCC | GAGTGAGGT | X | X | X | X |
| 3 | 2 | 1 | AGCAATGTC | AAAAA | GAGTGAGGC | X | X | X | X |
| 3 | 2 | 1 | AGTAGCGTT | TTTAG | GAGTGAGGT | X | X | X | X |
| 3 | 2 | 1 | GGCAGAGTC | AGGGCT | GAGTGAGGC | X | X | X | X |
| 3 | 2 | 1 | TGCAGCTTC | ATGGT | GAGTGAGGC | X | X | X | X |
| 3 | 3 | 0 | AGCATAGTT | ACCTGG | GAGTGAGGA | X | X | X | X |
| 3 | 3 | 0 | AGTAAAGTC | TAAGTA | GAGTGAGGA | X | X | X | X |
| 3 | 3 | 0 | AGCATTGTT | CTGCG | GAGTGAGGA | X | X | X | X |
| 4 | 3 | 1 | TGCAGTCTC | CTTGG | GAGTGAGGT | X | X | X | X |
| 2 | 0 | 2 | AGCAGCGTC | CACTTC | CAGAGAGGA | X | X | X | |
| 2 | 1 | 1 | AGCAGCGTG | GACCCA | GAGTGAGCA | X | X | X | |
| 2 | 1 | 1 | AGCAGCGCC | AATCC | GAGTGAGAA | X | X | X | |
| 2 | 1 | 1 | AGCAGCGGC | AGGCT | GAGAGAGGA | X | X | X | |
| 2 | 1 | 1 | AGCAGCTTC | TGCCTT | GAGTGAGTA | X | X | X | |
| 2 | 1 | 1 | AGCAGCTTC | ACTGT | CAGTGAGGA | X | X | X | |
| 2 | 1 | 1 | ATCAGCGTC | TTCAG | AAGTGAGGA | X | X | X | |
| 2 | 1 | 1 | AGCAGCGTG | GACCCA | GAGTGAGCA | X | X | X | |
| 2 | 1 | 1 | AGCAGGGTC | AAGAAA | GAGTGAGTA | X | X | X | |
| 2 | 1 | 1 | AGCAGCGTT | ACACA | GAGTGGGGA | X | X | X | |
| 2 | 1 | 1 | AGCAGCGGC | AAGAGA | GAATGAGGA | X | X | X | |
| 2 | 1 | 1 | AGCAGAGTC | CAGGC | AAGTGAGGA | X | X | X | |
| 2 | 1 | 1 | AGCAGAGTC | CAGGC | AAGTGAGGA | X | X | X | |
| 2 | 1 | 1 | AGCAGGGTC | TGGGTA | GAGTGATGA | X | X | X | |
| 2 | 1 | 1 | AGCAGCGTG | GACCCA | GAGTGAGCA | X | X | X | |
| 2 | 2 | 0 | AGCAGCAGC | TAGCTA | GAGTGAGGA | X | X | X | |
| 2 | 2 | 0 | AGGAGCTTC | ACTAA | GAGTGAGGA | X | X | X | |
| 2 | 2 | 0 | AGCAGCCTG | CAATA | GAGTGAGGA | X | X | X | |
| 2 | 2 | 0 | ACCAGTGTC | TGAGCT | GAGTGAGGA | X | X | X | |
| 2 | 2 | 0 | AACAGAGTC | CCCAT | GAGTGAGGA | X | X | X | |
| 2 | 2 | 0 | AGCAGCCTG | GCCAGG | GAGTGAGGA | X | X | X | |
| 2 | 2 | 0 | AGCAGCAGC | AGTGA | GAGTGAGGA | X | X | X | |
| 2 | 2 | 0 | ATCAGAGTC | TTAGG | GAGTGAGGA | X | X | X | |
| 2 | 2 | 0 | AGCGGGGTC | TAGGGG | GAGTGAGGA | X | X | X | |
| 2 | 2 | 0 | AGCAGCGGA | CAAGT | GAGTGAGGA | X | X | X | |
| 3 | 0 | 3 | AGCAGCGTC | CCTGCC | TAGGGAGGG | X | X | X | |
| 3 | 0 | 3 | AGCAGCGTC | TTTTCT | ATGTGAGGC | X | X | X | |
| 3 | 0 | 3 | AGCAGCGTC | ACCTCT | GTGTGGGGC | X | X | X | |
| 3 | 0 | 3 | AGCAGCGTC | TAAGG | GAGGGGGGT | X | X | X | |
| 3 | 0 | 3 | AGCAGCGTC | TTGGG | GTGTGGGGC | X | X | X | |
| 3 | 0 | 3 | AGCAGCGTC | TAGAG | TAGAGAGGT | X | X | X | |
| 3 | 1 | 2 | AGCAGGGTC | TCCCAG | GAGTGTGAA | X | X | X | |
| 3 | 1 | 2 | AGCAGTGTC | TATTT | CAGTGAGGG | X | X | X | |
| 3 | 1 | 2 | AGCAGGGTC | AGCCCA | GAGTGGGGG | X | X | X | |
| 3 | 1 | 2 | AGCAGGGTC | AGGCA | CAGTGAGGC | X | X | X | |

| # of mutations T | (−) | (+) | (−) site | spacer | (+) site | 4 nM | 2 nM | 1 nM | 0.5 nM |
|---|---|---|---|---|---|---|---|---|---|
| 3 | 1 | 2 | AGCAGGGTC | CTCTG | GAGTGGGGG | X | X | X | |
| 3 | 1 | 2 | GGCAGCGTC | CGGAG | GAGTGAAGG | X | X | X | |
| 3 | 1 | 2 | GGCAGCGTC | ACTCCA | GAGTTAGGT | X | X | X | |
| 3 | 1 | 2 | AGCAGGGTC | ATTCAT | CAGTGAGGC | X | X | X | |
| 3 | 1 | 2 | AGCAGAGTC | CTGTCA | GAGGGAGGC | X | X | X | |
| 3 | 1 | 2 | AGCAGCATC | TTCTG | GAGTGAGAC | X | X | X | |
| 3 | 1 | 2 | AGCATCGTC | TTTCT | GTGTGAGGC | X | X | X | |
| 3 | 1 | 2 | AGCAGTGTC | TCACAG | GAGGGAGGG | X | X | X | |
| 3 | 1 | 2 | GGCAGCGTC | CAGGA | GAGAGAGGT | X | X | X | |
| 3 | 1 | 2 | AGCAGCGGC | CCCGG | GAGTTAGGT | X | X | X | |
| 3 | 1 | 2 | AGCAGCGGC | GGGTGG | GAGTGGGGG | X | X | X | |
| 3 | 1 | 2 | AGCAGTGTC | CAGAC | GAGGGAGGT | X | X | X | |
| 3 | 1 | 2 | AGCAGTGTC | TATGA | GAGGGAGGG | X | X | X | |
| 3 | 1 | 2 | AGCAGTGTC | AGCCAT | GAGGGAGGG | X | X | X | |
| 3 | 1 | 2 | AGCAGTGTC | CCTGTG | GAGGGAGGT | X | X | X | |
| 3 | 1 | 2 | AGCACCGTC | TGCCA | GAGTGGGCA | X | X | X | |
| 3 | 2 | 1 | AGCCACGTC | CACAC | TAGTGAGGA | X | X | X | |
| 3 | 2 | 1 | AGTAGCGCC | AAAAG | GAGTGAGGT | X | X | X | |
| 3 | 2 | 1 | AACAGGGTC | TTTGAC | GAGTGAGGC | X | X | X | |
| 3 | 2 | 1 | GGCAGGGTC | TCAAT | GAGTGAGGG | X | X | X | |
| 3 | 2 | 1 | AACAGGGTC | CCTGA | GAGTGAGGG | X | X | X | |
| 3 | 2 | 1 | AGGAGAGTC | CAGGT | GAGTGAGGG | X | X | X | |
| 3 | 2 | 1 | AGCAGCCGC | CAACA | GAGTGAGGG | X | X | X | |
| 3 | 2 | 1 | GGCAGAGTC | AGTGTT | GAGTGAGGG | X | X | X | |
| 3 | 2 | 1 | AGCAGTGTG | TGAGCT | GAGTGAGGC | X | X | X | |
| 3 | 2 | 1 | AGCATCTTC | CAGTG | GAGTGAGGG | X | X | X | |
| 3 | 2 | 1 | AGCAGAGTG | GTTGA | GAGTGAGGT | X | X | X | |
| 3 | 2 | 1 | ATCAGTGTC | CCAGA | GAGTGAGGG | X | X | X | |
| 3 | 2 | 1 | TTCAGCGTC | CAAGAA | GAGTGAGGT | X | X | X | |
| 3 | 2 | 1 | AGCAACTTC | CGGACA | GAGTAAGGA | X | X | X | |
| 3 | 2 | 1 | AGCAGCGGG | AGATG | GAGTGAGGC | X | X | X | |
| 3 | 2 | 1 | AGTAGCGTG | GAGAG | GAGTGAGGT | X | X | X | |
| 3 | 2 | 1 | AGCTGCATC | TTTGG | GAGTGAGGT | X | X | X | |
| 3 | 2 | 1 | ATCAGAGTC | AAAGAA | GAGTGAGGT | X | X | X | |
| 3 | 2 | 1 | AGCAGGATC | TGAAAT | GAGTGAGGT | X | X | X | |
| 3 | 2 | 1 | AGCCACGTC | CAGTTT | TAGTGAGGA | X | X | X | |
| 3 | 2 | 1 | AGCAATGTC | TCAAAT | CAGTGAGGA | X | X | X | |
| 3 | 2 | 1 | AGCAATGTC | TGAAA | CAGTGAGGA | X | X | X | |
| 3 | 2 | 1 | GGCTGCGTC | ATCGG | GAGTGAGGT | X | X | X | |
| 3 | 2 | 1 | GGCAGAGTC | AAAAT | GAGTGAGGT | X | X | X | |
| 3 | 2 | 1 | AGCAGTGTG | CATGT | GAGTGAGGT | X | X | X | |
| 3 | 3 | 0 | GGCAACATC | AAACAG | GAGTGAGGA | X | X | X | |
| 3 | 3 | 0 | CCCAGCGGC | TGGCAG | GAGTGAGGA | X | X | X | |
| 3 | 3 | 0 | AGCCTGGTC | GGAGAG | GAGTGAGGA | X | X | X | |
| 3 | 3 | 0 | TGCAGTCTC | TATGG | GAGTGAGGA | X | X | X | |
| 3 | 3 | 0 | AGCATTGTA | GAGGC | GAGTGAGGA | X | X | X | |
| 3 | 3 | 0 | AGCCTGGTC | TCACA | GAGTGAGGA | X | X | X | |
| 3 | 3 | 0 | AGCATAGTG | AATAT | GAGTGAGGA | X | X | X | |
| 3 | 3 | 0 | AGCAAAGGC | ACCAG | GAGTGAGGA | X | X | X | |
| 3 | 3 | 0 | AACATGGTC | CACGT | GAGTGAGGA | X | X | X | |
| 3 | 3 | 0 | AGCTTTGTC | AACCTA | GAGTGAGGA | X | X | X | |
| 3 | 3 | 0 | AGCAAAGGC | AAAAA | GAGTGAGGA | X | X | X | |
| 3 | 3 | 0 | ATCAAGGTC | TTTTG | GAGTGAGGA | X | X | X | |
| 3 | 3 | 0 | GCCAGTGTC | TCGTCT | GAGTGAGGA | X | X | X | |
| 3 | 3 | 0 | TGCAAAGTC | AGATCT | GAGTGAGGA | X | X | X | |
| 4 | 1 | 3 | AGCAACGTC | TACAG | GAGGAAGGT | X | X | X | |
| 4 | 1 | 3 | AGCAACGTC | CCAGGA | AAGTGAAGG | X | X | X | |
| 4 | 2 | 2 | GGCAGTGTC | CAGTAG | GAGTGAGAT | X | X | X | |
| 4 | 2 | 2 | AGCAAAGTC | TCACA | AAGTGAGGT | X | X | X | |
| 4 | 3 | 1 | TGCTGTGTC | AAACCC | GAGTGAGGT | X | X | X | |
| 4 | 3 | 1 | GGCAAGGTC | TCTGTG | GAGTGAGGG | X | X | X | |
| 4 | 3 | 1 | ATCAACGTG | TCTCA | GAGTGAGGC | X | X | X | |
| 2 | 0 | 2 | AGCAGCGTC | TGAGGC | GGGTGAGAA | X | X | | X |
| 2 | 0 | 2 | AGCAGCGTC | TGCATG | GTGTGGGA | X | X | | X |
| 2 | 1 | 1 | AGCAGAGTC | AGGCA | GAGTGAGAA | X | X | | X |
| 2 | 1 | 1 | AGCAGCTTC | ATTTAT | GAGTGAGCA | X | X | | X |
| 2 | 1 | 1 | GGCAGCGTC | CTTCT | GAGTGAGCA | X | X | | X |
| 2 | 1 | 1 | AGCAGTGTC | GTGAA | GAGTCAGGA | X | X | | X |
| 2 | 1 | 1 | AGCAGCTTC | CGGGGA | GAGAGAGGA | X | X | | X |
| 2 | 2 | 0 | AGCAGCTGC | GGACC | GAGTGAGGA | X | X | | X |
| 2 | 2 | 0 | AGCAGTGGC | ATTAA | GAGTGAGGA | X | X | | X |
| 2 | 2 | 0 | AGCAGCATG | CACAT | GAGTGAGGA | X | X | | X |

| # of mutations | | | | | | | VF2468 concentration | | | |
|---|---|---|---|---|---|---|---|---|---|---|
| T | (−) | (+) | (−) site | spacer | (+) site | | 4 nM | 2 nM | 1 nM | 0.5 nM |
| 2 | 2 | 0 | AGCAGCATG | ACCAA | GAGTGAGGA | | X | X | | X |
| 2 | 2 | 0 | ACCAGGGTC | TGTGGG | GAGTGAGGA | | X | X | | X |
| 2 | 2 | 0 | AGCAGCATG | AAAAGG | GAGTGAGGA | | X | X | | X |
| 2 | 2 | 0 | AGCAGGGTG | ATGGA | GAGTGAGGA | | X | X | | X |
| 2 | 2 | 0 | AGCAGTGAC | CGAAG | GAGTGAGGA | | X | X | | X |
| 2 | 2 | 0 | AGCAGATTC | CTCAG | GAGTGAGGA | | X | X | | X |
| 2 | 2 | 0 | ATCAGCGTG | GCCAT | GAGTGAGGA | | X | X | | X |
| 2 | 2 | 0 | AGCAGGGGC | AAGAGA | GAGTGAGGA | | X | X | | X |
| 2 | 2 | 0 | AGCGCCGTC | CACAGG | GAGTGAGGA | | X | X | | X |
| 3 | 0 | 3 | AGCAGCGTC | CCCTG | GAGTGGCCA | | X | X | | X |
| 3 | 0 | 3 | AGCAGCGTC | CAGTGG | GAGTGGGCC | | X | X | | X |
| 3 | 0 | 3 | AGCAGCGTC | CTTCCT | CAGTGAGAC | | X | X | | X |
| 3 | 1 | 2 | AGCAGCGGC | GGCGGG | GAGGGAGGC | | X | X | | X |
| 3 | 1 | 2 | AGCAGAGTC | TGTTGA | GAGTGAGAC | | X | X | | X |
| 3 | 1 | 2 | TGCAGCGTC | AGAAG | GTGTGAGGC | | X | X | | X |
| 3 | 1 | 2 | AGCAGCGTG | CCTCT | GGGTGAGGC | | X | X | | X |
| 3 | 1 | 2 | AGCAGCTTC | CATCTG | GAGTGAGTC | | X | X | | X |
| 3 | 1 | 2 | AGCAGCATC | TGCTCT | TAGTGAGGC | | X | X | | X |
| 3 | 1 | 2 | AGCAACGTC | CTGCA | GAGGGAGAA | | X | X | | X |
| 3 | 1 | 2 | AGCAGCGGC | CCGCA | GAGGGAGGC | | X | X | | X |
| 3 | 1 | 2 | AGCAACGTC | AGCAA | CAGTGAGAA | | X | X | | X |
| 3 | 1 | 2 | AGTAGCGTC | TCGAA | GAGAGAGGC | | X | X | | X |
| 3 | 1 | 2 | AGCAGCGTT | TTCAG | GAGGGAGGG | | X | X | | X |
| 3 | 1 | 2 | AGCAGCGGC | ACCCT | GGGTGAGGC | | X | X | | X |
| 3 | 2 | 1 | AGCAAGGTC | AACTCA | GAGTGAGAA | | X | X | | X |
| 3 | 2 | 1 | AGCATGGTC | AGTTTC | TAGTGAGGA | | X | X | | X |
| 3 | 2 | 1 | AGTAGGGTC | ACGCCA | GAGTGAGGC | | X | X | | X |
| 3 | 2 | 1 | ATCAGGGTC | CTGTT | GAGTGAGGG | | X | X | | X |
| 3 | 2 | 1 | AGCATGGTC | TTTTTC | TAGTGAGGA | | X | X | | X |
| 3 | 2 | 1 | AGCAGGGTA | AGAGGG | GAGTGAGGG | | X | X | | X |
| 3 | 2 | 1 | GGCAACGTC | AACTCA | GAGTGAGAA | | X | X | | X |
| 3 | 2 | 1 | GCCAGCGTC | TTGGGT | GAGTGAGGT | | X | X | | X |
| 3 | 2 | 1 | AGCAGCTTT | CTGCT | GAGTGAGGC | | X | X | | X |
| 3 | 2 | 1 | AGCAGTGGC | TGCGG | GAGTGAGGC | | X | X | | X |
| 3 | 2 | 1 | GGCAGCATC | TGGGC | GAGTGAGGC | | X | X | | X |
| 3 | 2 | 1 | GGCAGCATC | TGAAT | GAGTGAGGC | | X | X | | X |
| 3 | 2 | 1 | AGCAGTGTA | TGTGG | GAGTGAGGT | | X | X | | X |
| 3 | 2 | 1 | AGGAGAGTC | CCTGG | GAGTGAGGC | | X | X | | X |
| 3 | 2 | 1 | AGCATGGTC | AGATTC | TAGTGAGGA | | X | X | | X |
| 3 | 2 | 1 | ATCAGGGTC | TTGAGG | GAGTGAGGT | | X | X | | X |
| 3 | 2 | 1 | AACAGCGTG | CTGTA | GAGTGAGGT | | X | X | | X |
| 3 | 2 | 1 | AGTAGCTTC | TGTGG | GAGTGAGGC | | X | X | | X |
| 3 | 2 | 1 | AGCAACTTC | TTGAT | GAGTGAGAA | | X | X | | X |
| 3 | 2 | 1 | AGCATGGTC | AGGTTC | TAGTGAGGA | | X | X | | X |
| 3 | 2 | 1 | AGAAGTGTC | AGAGTA | GAGTGAGGC | | X | X | | X |
| 3 | 2 | 1 | AACAGCGGC | ATGGG | GAGTGAGGC | | X | X | | X |
| 3 | 2 | 1 | AGCAGTGGC | ATCTAG | GAGTGAGGC | | X | X | | X |
| 3 | 3 | 0 | AAAAGTGTC | ATATAG | GAGTGAGGA | | X | X | | X |
| 3 | 3 | 0 | AGCAATGGC | TGGAT | GAGTGAGGA | | X | X | | X |
| 3 | 3 | 0 | GCCACCGTC | GGTGAG | GAGTGAGGA | | X | X | | X |
| 3 | 3 | 0 | AAAAGTGTC | AGTAGA | GAGTGAGGA | | X | X | | X |
| 3 | 3 | 0 | AACATTGTC | TAGTGG | GAGTGAGGA | | X | X | | X |
| 3 | 3 | 0 | AACATTGTC | TAGTGA | GAGTGAGGA | | X | X | | X |
| 3 | 3 | 0 | AACATTGTC | TAGTGG | GAGTGAGGA | | X | X | | X |
| 3 | 3 | 0 | AACATTGTC | TAGTGA | GAGTGAGGA | | X | X | | X |
| 3 | 3 | 0 | AACATTGTC | TAGTGG | GAGTGAGGA | | X | X | | X |
| 3 | 3 | 0 | AACATTGTC | TAGTGA | GAGTGAGGA | | X | X | | X |
| 3 | 3 | 0 | AACATTGTC | TAGTGG | GAGTGAGGA | | X | X | | X |
| 3 | 3 | 0 | AACATTGTC | TAGTGA | GAGTGAGGA | | X | X | | X |
| 3 | 3 | 0 | AACATTGTC | TAGTGG | GAGTGAGGA | | X | X | | X |
| 3 | 3 | 0 | AACATTGTC | TAGTGA | GAGTGAGGA | | X | X | | X |
| 3 | 3 | 0 | AACATTGTC | TAGTGG | GAGTGAGGA | | X | X | | X |
| 3 | 3 | 0 | AACATTGTC | TAGTGA | GAGTGAGGA | | X | X | | X |
| 3 | 3 | 0 | AACATTGTC | TAGTGG | GAGTGAGGA | | X | X | | X |
| 3 | 3 | 0 | AACATTGTC | TAGTGA | GAGTGAGGA | | X | X | | X |
| 3 | 3 | 0 | ATCAACTTC | TTCAGG | GAGTGAGGA | | X | X | | X |
| 3 | 3 | 0 | AGCATGGTG | ATTAA | GAGTGAGGA | | X | X | | X |
| 4 | 3 | 1 | AGTAGTCTC | TGGCT | GAGTGAGGT | | X | X | | X |
| 4 | 3 | 1 | AGCATTGTT | TCTCA | GAGTGAGGT | | X | X | | X |
| 4 | 3 | 1 | AGCAAGGTT | AGGCT | GAGTGAGGG | | X | X | | X |
| 4 | 3 | 1 | AGCAGTCTT | CCACCA | GAGTGAGGC | | X | X | | X |
| 4 | 3 | 1 | AGCATTGTT | TGAGT | GAGTGAGGT | | X | X | | X |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 2 | 0 | 2 | AGCAGCGTC | CGCAGC | AAGTTAGGA | X | X | | |
| 2 | 0 | 2 | AGCAGCGTC | ACTACA | GAGGCAGGA | X | X | | |
| 2 | 1 | 1 | GGCAGCGTC | TCTCTG | GGGTGAGGA | X | X | | |
| 2 | 1 | 1 | AGCAGAGTC | TTGAA | GAGTGAGTA | X | X | | |
| 2 | 1 | 1 | AGCAGCATC | TATGC | CAGTGAGGA | X | X | | |
| 2 | 1 | 1 | AGCAGAGTC | TGGCA | GAGAGAGGA | X | X | | |
| 2 | 1 | 1 | AGCAGTGTC | CCTCA | GAGTGTGGA | X | X | | |
| 2 | 1 | 1 | AGCAGCATC | TTGGA | GTGTGAGGA | X | X | | |
| 2 | 1 | 1 | AGCTGCGTC | TTCTG | GAGGGAGGA | X | X | | |
| 2 | 1 | 1 | AGCAGCTTC | AGAAGA | GAATGAGGA | X | X | | |
| 2 | 1 | 1 | AGCAGGGTC | GAGGG | GAGGGAGGA | X | X | | |
| 2 | 1 | 1 | AGCAGGGTC | TGGTG | CAGTGAGGA | X | X | | |
| 2 | 1 | 1 | AGCAGCATC | CATGT | CAGTGAGGA | X | X | | |
| 2 | 1 | 1 | AGCAGAGTC | CCAAG | GGGTGAGGA | X | X | | |
| 2 | 1 | 1 | AGCAGCCTC | TGAAC | AAGTGAGGA | X | X | | |
| 2 | 1 | 1 | AGCAGCCTC | TAGGT | AAGTGAGGA | X | X | | |
| 2 | 1 | 1 | AGCAGCTTC | AGATTT | GAGTTAGGA | X | X | | |
| 2 | 1 | 1 | AGCAGCCTC | ACAGG | CAGTGAGGA | X | X | | |
| 2 | 1 | 1 | AGCAGCATC | AACAC | CAGTGAGGA | X | X | | |
| 2 | 1 | 1 | AGCAGCGTG | TCAGCT | GTGTGAGGA | X | X | | |
| 2 | 1 | 1 | AGCAGCATC | TATGC | CAGTGAGGA | X | X | | |
| 2 | 1 | 1 | AGCAGCATC | AATAAT | AAGTGAGGA | X | X | | |
| 2 | 1 | 1 | AGCAGAGTC | ACCCA | GTGTGAGGA | X | X | | |
| 2 | 1 | 1 | GGCAGCGTC | TGGGAG | GAGTTAGGA | X | X | | |
| 2 | 1 | 1 | AGCAGCGCC | ATCTT | GAGCGAGGA | X | X | | |
| 2 | 1 | 1 | AGCTGCGTC | GTGAG | AAGTGAGGA | X | X | | |
| 2 | 1 | 1 | AGCAGGGTC | ACACA | GGGTGAGGA | X | X | | |
| 2 | 1 | 1 | AGCAGAGTC | AGAGAG | GAGAGAGGA | X | X | | |
| 2 | 1 | 1 | AGCAGAGTC | ACTGAC | CAGTGAGGA | X | X | | |
| 2 | 1 | 1 | AGCAGTGTC | TCCCA | GAGTGTGGA | X | X | | |
| 2 | 1 | 1 | AGCAGTGTC | TGAGTA | GAGTGTGGA | X | X | | |
| 2 | 1 | 1 | AGCAGCATC | CCGGG | GAGTGAAGA | X | X | | |
| 2 | 1 | 1 | AACAGCGTC | AAGGCA | GAGTGAAGA | X | X | | |
| 2 | 1 | 1 | AGCAGCGCC | ATCTT | GAGCGAGGA | X | X | | |
| 2 | 1 | 1 | AGCAGCGCC | ATCTT | GAGCGAGGA | X | X | | |
| 2 | 1 | 1 | AGCAGCGCC | ATCTT | GAGCGAGGA | X | X | | |
| 2 | 1 | 1 | AGCAGCGCC | ATCTT | GAGCGAGGA | X | X | | |
| 2 | 1 | 1 | AGCAGCGCC | ATCTT | GAGCGAGGA | X | X | | |
| 2 | 1 | 1 | AGCAGCGCC | ATCTT | GAGCGAGGA | X | X | | |
| 2 | 1 | 1 | AGCAGCGCC | ATCTT | GAGCGAGGA | X | X | | |
| 2 | 1 | 1 | AGCAGCATC | CATGT | CAGTGAGGA | X | X | | |
| 2 | 1 | 1 | AGCAGAGTC | AGGGAG | GAGTGAAGA | X | X | | |
| 2 | 1 | 1 | AGCAGCCTC | ATGGTC | AAGTGAGGA | X | X | | |
| 2 | 1 | 1 | AGCAGCATC | GTGAGT | GAGTGTGGA | X | X | | |
| 2 | 1 | 1 | AGCAGTGTC | TAGCAC | GAATGAGGA | X | X | | |
| 2 | 1 | 1 | AGCAGAGTC | ACAGAA | GAGAGAGGA | X | X | | |
| 2 | 1 | 1 | AGCAGCGTG | GTTAA | GAGTCAGGA | X | X | | |
| 2 | 1 | 1 | ACCAGCGTC | TGGTGA | GAGTGGGGA | X | X | | |
| 2 | 1 | 1 | AGCAGTGTC | TTGCT | GAGAGAGGA | X | X | | |
| 2 | 1 | 1 | AGCAGCGAC | CTGGGC | GAGTGAGAA | X | X | | |
| 2 | 1 | 1 | AGCAGTGTC | TGCCGT | GAGTGGGGA | X | X | | |
| 2 | 1 | 1 | AGCAGCGTA | ATACA | CAGTGAGGA | X | X | | |
| 2 | 1 | 1 | AGCAGCCTC | TAGAGA | AAGTGAGGA | X | X | | |
| 2 | 1 | 1 | AGCAGAGTC | ACGGGT | GTGTGAGGA | X | X | | |
| 2 | 1 | 1 | TGCAGCGTC | ATCAA | GAGTGTGGA | X | X | | |
| 2 | 2 | 0 | AGCAGGGAC | CAGGTG | GAGTGAGGA | X | X | | |
| 2 | 2 | 0 | AGCAGGCTC | TAAAAT | GAGTGAGGA | X | X | | |
| 2 | 2 | 0 | AGCAGCCTA | GGAAT | GAGTGAGGA | X | X | | |
| 2 | 2 | 0 | AGCATCCTC | CAGGAG | GAGTGAGGA | X | X | | |
| 2 | 2 | 0 | AGCAGAGTA | CTCAGT | GAGTGAGGA | X | X | | |
| 2 | 2 | 0 | AGCAGGGTA | GAAGA | GAGTGAGGA | X | X | | |
| 2 | 2 | 0 | AGCAGAGAC | CTGAGG | GAGTGAGGA | X | X | | |
| 2 | 2 | 0 | AGCAGAGTG | GGCAA | GAGTGAGGA | X | X | | |
| 2 | 2 | 0 | AGCTGCCTC | GGTGGG | GAGTGAGGA | X | X | | |
| 2 | 2 | 0 | AGGAGGGTC | CTGGAT | GAGTGAGGA | X | X | | |
| 2 | 2 | 0 | AGCAGACTC | CTTGAT | GAGTGAGGA | X | X | | |
| 2 | 2 | 0 | AGCAGAGTA | TTTGG | GAGTGAGGA | X | X | | |
| 2 | 2 | 0 | AGCAGAGTT | GCCAG | GAGTGAGGA | X | X | | |
| 2 | 2 | 0 | AGCAGCACC | AAAATG | GAGTGAGGA | X | X | | |
| 2 | 2 | 0 | AGCAGGATC | AGGTTA | GAGTGAGGA | X | X | | |
| 2 | 2 | 0 | TGCAGCATC | CTTCAG | GAGTGAGGA | X | X | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 2 | 2 | 0 | AGCAGAGTG | TGGTG | GAGTGAGGA | X | X | | |
| 2 | 2 | 0 | AGCAGTGCC | TACCA | GAGTGAGGA | X | X | | |
| 2 | 2 | 0 | AGCAGAGTA | CCCAT | GAGTGAGGA | X | X | | |
| 2 | 2 | 0 | AGCAGAGTG | AAAGGA | GAGTGAGGA | X | X | | |
| 2 | 2 | 0 | AGCAGGATC | AAGAAA | GAGTGAGGA | X | X | | |
| 2 | 2 | 0 | AGCAGCTTG | TGTCAT | GAGTGAGGA | X | X | | |
| 2 | 2 | 0 | AGCAGAGTA | GGTTGT | GAGTGAGGA | X | X | | |
| 3 | 0 | 3 | AGCAGCGTC | TGCAGT | TTGTGGGGA | X | X | | |
| 3 | 0 | 3 | AGCAGCGTC | AGGGGA | TTGTGGGGA | X | X | | |
| 3 | 0 | 3 | AGCAGCGTC | CAAGA | GAGTTACAA | X | X | | |
| 3 | 0 | 3 | AGCAGCGTC | AAAGT | TTGAGAGGA | X | X | | |
| 3 | 0 | 3 | AGCAGCGTC | AGGCTT | CAGTGTGAA | X | X | | |
| 3 | 0 | 3 | AGCAGCGTC | AGGCTT | CAGTGTGAA | X | X | | |
| 3 | 0 | 3 | AGCAGCGTC | TTTTT | GAGAGAAGG | X | X | | |
| 3 | 0 | 3 | AGCAGCGTC | GGGGA | GAGTTGGGG | X | X | | |
| 3 | 0 | 3 | AGCAGCGTC | TCCAG | GAACGTGGA | X | X | | |
| 3 | 0 | 3 | AGCAGCGTC | CTTGGG | GAGTTTGGG | X | X | | |
| 3 | 0 | 3 | AGCAGCGTC | GTCAC | AGGGGAGGA | X | X | | |
| 3 | 0 | 3 | AGCAGCGTC | CAAAA | GGCTGAGGG | X | X | | |
| 3 | 0 | 3 | AGCAGCGTC | CGTCG | CAGTGGGGC | X | X | | |
| 3 | 0 | 3 | AGCAGCGTC | CGCACT | GAGGGGGCA | X | X | | |
| 3 | 0 | 3 | AGCAGCGTC | TCTGC | GGGAGAGGC | X | X | | |
| 3 | 0 | 3 | AGCAGCGTC | ATCTT | GAGTGGAGC | X | X | | |
| 3 | 0 | 3 | AGCAGCGTC | AGCGA | CAGAGAGGC | X | X | | |
| 3 | 0 | 3 | AGCAGCGTC | TGTAT | GTGTCAGAA | X | X | | |
| 3 | 0 | 3 | AGCAGCGTC | ATTAGG | GCATGAGCA | X | X | | |
| 3 | 0 | 3 | AGCAGCGTC | GATGGA | AAGGGAAGA | X | X | | |
| 3 | 0 | 3 | AGCAGCGTC | AGGAA | GAGTTGTGA | X | X | | |
| 3 | 0 | 3 | AGCAGCGTC | TACCGT | GAGTGCTCA | X | X | | |
| 3 | 0 | 3 | AGCAGCGTC | AGGGT | TTGAGAGGA | X | X | | |
| 3 | 0 | 3 | AGCAGCGTC | ATGAGT | GTGTAATGA | X | X | | |
| 3 | 0 | 3 | AGCAGCGTC | TCTTTA | GAGTGGGTT | X | X | | |
| 3 | 0 | 3 | AGCAGCGTC | CTGTG | GAGGCAGAA | X | X | | |
| 3 | 0 | 3 | AGCAGCGTC | AGGCTT | CAGTGTGAA | X | X | | |
| 3 | 0 | 3 | AGCAGCGTC | AGGCTT | CAGTGTGAA | X | X | | |
| 3 | 0 | 3 | AGCAGCGTC | AGGCTT | CAGTGTGAA | X | X | | |
| 3 | 0 | 3 | AGCAGCGTC | AGGCTT | CAGTGTGAA | X | X | | |
| 3 | 0 | 3 | AGCAGCGTC | AGGCTT | CAGTGTGAA | X | X | | |
| 3 | 0 | 3 | AGCAGCGTC | AGGCTT | CAGTGTGAA | X | X | | |
| 3 | 0 | 3 | AGCAGCGTC | AGGGT | TTGAGAGGA | X | X | | |
| 3 | 0 | 3 | AGCAGCGTC | ACACTC | TACTGAGGT | X | X | | |
| 3 | 0 | 3 | AGCAGCGTC | ACATGC | CAGCGAGGT | X | X | | |
| 3 | 0 | 3 | AGCAGCGTC | CATGGT | GACAGAGGT | X | X | | |
| 3 | 0 | 3 | AGCAGCGTC | TTCCCT | GAGAGAGCT | X | X | | |
| 3 | 0 | 3 | AGCAGCGTC | CAGGA | GAGGAAGGC | X | X | | |
| 3 | 0 | 3 | AGCAGCGTC | ATACA | GGCTGAGGT | X | X | | |
| 3 | 0 | 3 | AGCAGCGTC | TGCAT | GAAGGAGGT | X | X | | |
| 3 | 0 | 3 | AGCAGCGTC | CCAGT | GAGCGATGG | X | X | | |
| 3 | 0 | 3 | AGCAGCGTC | TTGCA | AAGGGAGAA | X | X | | |
| 3 | 0 | 3 | AGCAGCGTC | AGGGT | TTGAGAGGA | X | X | | |
| 3 | 0 | 3 | AGCAGCGTC | CACGT | GTGTGCGGT | X | X | | |
| 3 | 0 | 3 | AGCAGCGTC | AGCCTC | TAGAGGGGA | X | X | | |
| 3 | 0 | 3 | AGCAGCGTC | CGCAG | GAGGTAGGG | X | X | | |
| 3 | 0 | 3 | AGCAGCGTC | CAAGA | GTGTTACGA | X | X | | |
| 3 | 0 | 3 | AGCAGCGTC | CTAGC | CTGTGAGGG | X | X | | |
| 3 | 0 | 3 | AGCAGCGTC | CTCCTG | GAGGGAGAG | X | X | | |
| 3 | 0 | 3 | AGCAGCGTC | AGGGAG | GAGGGAGA | X | X | | |
| 3 | 0 | 3 | AGCAGCGTC | CCCCCG | CAGTGATGG | X | X | | |
| 3 | 0 | 3 | AGCAGCGTC | TCCTGA | GAGAGAAGG | X | X | | |
| 3 | 0 | 3 | AGCAGCGTC | TGTCCT | GAGTCCAGA | X | X | | |
| 3 | 0 | 3 | AGCAGCGTC | AAGGAT | TAGAGAGTA | X | X | | |
| 3 | 0 | 3 | AGCAGCGTC | TCCTGA | GAGAGAAGG | X | X | | |
| 3 | 1 | 2 | AGTAGCGTC | CTAAT | GAGTGTGAA | X | X | | |
| 3 | 1 | 2 | AGCAGCTTC | TCCATG | GAGTGAGAC | X | X | | |
| 3 | 1 | 2 | AGCAGGGTC | GGGGA | GAGGGAGGG | X | X | | |
| 3 | 1 | 2 | AGCAGCATC | CAGACT | CAGTGAGGT | X | X | | |
| 3 | 1 | 2 | AGCAGGGTC | AGCTAA | GAGGGAGGC | X | X | | |
| 3 | 1 | 2 | AGCAGCGGC | AGCGA | GAGTGATGT | X | X | | |
| 3 | 1 | 2 | GGCAGCGTC | TGACG | GAGTGAGTG | X | X | | |
| 3 | 1 | 2 | AGCAGTGTC | AGGTAG | GAGAGAGGC | X | X | | |
| 3 | 1 | 2 | AGCAGGGTC | TGAGTG | GAGTAAGGT | X | X | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 3 | 1 | 2 | AGCAGTGTC | AGCTGG | TAGTGAGAA | X | X | | |
| 3 | 1 | 2 | AGCACCGTC | TGGGG | GAGGGAAGA | X | X | | |
| 3 | 1 | 2 | AGCAGCATC | AGCATG | GAGGGAGGC | X | X | | |
| 3 | 1 | 2 | AGCAGCCTC | GGTCAA | GAGTGAGAG | X | X | | |
| 3 | 1 | 2 | GGCAGCGTC | AATAA | AAGTGAGGG | X | X | | |
| 3 | 1 | 2 | AGCAACGTC | GGCAG | CAGTGGGGA | X | X | | |
| 3 | 1 | 2 | AGCAACGTC | AGCAAA | GTCTGAGGA | X | X | | |
| 3 | 1 | 2 | AGCAGGGTC | AGTGTC | TAGTGAGAA | X | X | | |
| 3 | 1 | 2 | AGCAGGGTC | AGGATG | GAGTGGGGT | X | X | | |
| 3 | 1 | 2 | AGCAGTGTC | AGTGAA | CAGTGAGGT | X | X | | |
| 3 | 1 | 2 | AGCAGGGTC | AGTGCC | TAGTGAGGG | X | X | | |
| 3 | 1 | 2 | AGCAGCGTA | CGGACT | GAGTGAGCC | X | X | | |
| 3 | 1 | 2 | AGCAGCTTC | CCCAGT | AAGTGAGAA | X | X | | |
| 3 | 1 | 2 | AGCAGCGGC | ACCTC | GAGAGAGAA | X | X | | |
| 3 | 1 | 2 | AGCAGTGTC | CTCAC | CAGTAAGGA | X | X | | |
| 3 | 1 | 2 | AGCAGGGTC | TGTTA | GAGTGAGTG | X | X | | |
| 3 | 1 | 2 | AGCAGCTTC | ACCTG | GAGGGAGGG | X | X | | |
| 3 | 1 | 2 | AGCACCGTC | ATCTAA | GGGTGAGGC | X | X | | |
| 3 | 1 | 2 | AGCATCGTC | CTGTG | GAGCGAGGG | X | X | | |
| 3 | 1 | 2 | AGCAGGGTC | CTTACT | CAGTGAGGT | X | X | | |
| 3 | 1 | 2 | AGCAGAGTC | TGAGA | GTGTGAGGT | X | X | | |
| 3 | 1 | 2 | AGCAGCGTG | CAGTGA | CAGTGAGGC | X | X | | |
| 3 | 1 | 2 | AGCACCGTC | ATTGGA | GAGGGAGAA | X | X | | |
| 3 | 1 | 2 | AGCAGCTTC | ACCTG | GAGGGAGGG | X | X | | |
| 3 | 1 | 2 | AGCAGAGTC | GCTGCA | GAGTGAGCC | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGAGTC | CTTGG | GAGGGAGGG | X | X | | |
| 3 | 1 | 2 | AGCAGCTTC | ACCTG | GAGGGAGGG | X | X | | |
| 3 | 1 | 2 | AGCAGCGTA | TGCATA | CAGTGAGGG | X | X | | |
| 3 | 1 | 2 | AGCAGTGTC | AGGCTG | GTGTGAGAA | X | X | | |
| 3 | 1 | 2 | AGCAGAGTC | GGCGTC | TAGTGAGGG | X | X | | |
| 3 | 1 | 2 | AGCAGCGTG | GGCCGG | GAGGGAGGT | X | X | | |
| 3 | 1 | 2 | GGCAGCGTC | CGATT | CAGTGAGGG | X | X | | |
| 3 | 1 | 2 | AGCAGCTTC | ACTGAA | GAGGGAGGC | X | X | | |
| 3 | 1 | 2 | ATCAGCGTC | TCTGG | GAGTGGGGC | X | X | | |
| 3 | 1 | 2 | AGCAGCGGC | AGGCGA | GAGTGACAA | X | X | | |
| 3 | 1 | 2 | AGCAGCTTC | AACGT | GAGTGATGT | X | X | | |
| 3 | 1 | 2 | AGCAGCTTC | CTGGG | GAGTGAGTT | X | X | | |
| 3 | 1 | 2 | AGCAGCATC | TCGTG | GAGGGAGGC | X | X | | |
| 3 | 1 | 2 | AGCAGAGTC | TTCAG | GAGAGAGGC | X | X | | |
| 3 | 1 | 2 | AGCAGGGTC | AAGTTC | CAGTGAGGG | X | X | | |
| 3 | 1 | 2 | AGCAGAGTC | AGTCTT | GAGTGAGTT | X | X | | |
| 3 | 1 | 2 | AGCAGAGTC | AGACTT | GAGTGAGTT | X | X | | |
| 3 | 1 | 2 | TGCAGCGTC | CAGAT | GAGGGAGGT | X | X | | |
| 3 | 1 | 2 | AGCATCGTC | AGAAT | GGGTGAGGG | X | X | | |
| 3 | 1 | 2 | AGCAGTGTC | CAGCTC | CAGTGAGGC | X | X | | |
| 3 | 1 | 2 | AGCAGCTTC | TAAAAG | GAGAGAGGT | X | X | | |
| 3 | 1 | 2 | AGCAGGGTC | CATGAG | GAGTGAGCC | X | X | | |
| 3 | 1 | 2 | AGCAGTGTC | ACCACA | GAGTGAAGG | X | X | | |
| 3 | 1 | 2 | AGCAGGGTC | AGGTTT | TAGTGAGGG | X | X | | |
| 3 | 1 | 2 | AGCAGCATC | AATGTC | TAGTGAGGG | X | X | | |
| 3 | 1 | 2 | AGCAGTGTC | CCGCAC | GAGGAAGGA | X | X | | |
| 3 | 1 | 2 | AGCAGCTTC | TTGTGA | GAGAGAGGT | X | X | | |
| 3 | 1 | 2 | AGCAGAGTC | CTAAGC | GGGTGAGGG | X | X | | |
| 3 | 1 | 2 | AGCAGTGTC | AAGTA | GAGTGAAGG | X | X | | |
| 3 | 1 | 2 | AGCATCGTC | AAGTTC | TGGTGAGGA | X | X | | |
| 3 | 1 | 2 | AGCAGGGTC | CCTGCT | GAGAGAGGG | X | X | | |
| 3 | 1 | 2 | AGCAGAGTC | AAGTCA | GAGAGAGGC | X | X | | |
| 3 | 1 | 2 | AGCAGCGGC | TGATG | GACTGAGGC | X | X | | |
| 3 | 1 | 2 | AGCAGAGTC | CAGTGG | GTGTGAGGC | X | X | | |
| 3 | 1 | 2 | AGCAGCGGC | TGATG | GACTGAGGC | X | X | | |
| 3 | 1 | 2 | AGCAGCGGC | AGCCGA | GAGAGAGGG | X | X | | |
| 3 | 1 | 2 | AGCAGCGGC | TGATG | GACTGAGGC | X | X | | |
| 3 | 1 | 2 | AGCAGCGGC | TGATG | GACTGAGGC | X | X | | |
| 3 | 1 | 2 | AGCAGCGGC | TGATG | GACTGAGGC | X | X | | |
| 3 | 1 | 2 | AGCAGCGGC | TGATG | GACTGAGGC | X | X | | |

| # of mutations | | | | | | VF2468 concentration | | | |
|---|---|---|---|---|---|---|---|---|---|
| T | (-) | (+) | (-) site | spacer | (+) site | 4 nM | 2 nM | 1 nM | 0.5 nM |
| 3 | 1 | 2 | AGCAGCGGC | AGCCGA | GAGAGAGGG | X | X | | |
| 3 | 1 | 2 | AGCAGCGGC | TGATG | GACTGAGGC | X | X | | |
| 3 | 1 | 2 | TGCAGCGTC | TTGTT | TAGTGAGGC | X | X | | |
| 3 | 1 | 2 | AGCAGTGTC | AGGCTG | GTGTGAGAA | X | X | | |
| 3 | 1 | 2 | AGCAGCGTA | GAGTGG | GAATGAGGG | X | X | | |
| 3 | 1 | 2 | AGCATCGTC | ACAGGA | GGGTGAGGT | X | X | | |
| 3 | 1 | 2 | AGCAGCGGC | ACCCA | GAATGAGGG | X | X | | |
| 3 | 1 | 2 | AGCAGCGTT | ATTTCA | GAGTGTGGT | X | X | | |
| 3 | 1 | 2 | AGCAGAGTC | GCTCCA | GAGTGAGCC | X | X | | |
| 3 | 1 | 2 | AGCAGTGTC | ATCTTT | GAGTGGGAA | X | X | | |
| 3 | 1 | 2 | AGCAGCATC | TCCTAG | CAGTGAGGG | X | X | | |
| 3 | 1 | 2 | AGCAACGTC | AGTGG | GACTGAGGG | X | X | | |
| 3 | 1 | 2 | AGCACCGTC | ATCTT | GAGTGAGCT | X | X | | |
| 3 | 1 | 2 | AGCAGGGTC | CTGAG | GGGAGAGGA | X | X | | |
| 3 | 1 | 2 | GGCAGCGTC | AGGAGA | GAGTGATGT | X | X | | |
| 3 | 1 | 2 | AGCATCGTC | GGGGAG | GAGTGGGAA | X | X | | |
| 3 | 1 | 2 | AGCAGTGTC | TGTGCT | CAGTGAGGT | X | X | | |
| 3 | 1 | 2 | AGCAGTGTC | AGTCCT | GAGAGAGCA | X | X | | |
| 3 | 1 | 2 | AGCAGCGTT | GCTTTC | TAGTGAGGT | X | X | | |
| 3 | 1 | 2 | AGCAGCGGC | GACAGG | GAGAGAGGG | X | X | | |
| 3 | 1 | 2 | AGCACCGTC | CTGAAA | CAGTGAGTA | X | X | | |
| 3 | 1 | 2 | AGCAGTGTC | TGCTGG | GAGGGTGGA | X | X | | |
| 3 | 1 | 2 | AGCAGCGCC | CTGTGG | GAGGGAGGT | X | X | | |
| 3 | 1 | 2 | AGCAGAGTC | AGAAA | GAGTAAGGC | X | X | | |
| 3 | 1 | 2 | AGCAGCTTC | TCTAAG | GAGTGGGGG | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | ATCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | ACCTG | GAGGGAGGG | X | X | | |
| 3 | 1 | 2 | AGCAGCTTC | CTGCTC | CAGTGAGGG | X | X | | |
| 3 | 1 | 2 | AGCAGCTTC | ACCTG | GAGGGAGGG | X | X | | |
| 3 | 1 | 2 | AGCAGAGTC | AAGAGG | GTGTGAGGG | X | X | | |
| 3 | 1 | 2 | AGCAGGGTC | CTGAAG | GAGGGAGGG | X | X | | |
| 3 | 1 | 2 | AGCAGGGTC | AGCCCA | GAGGGAGGC | X | X | | |
| 3 | 1 | 2 | GGCAGCGTC | ATTTT | GAGTGGGGG | X | X | | |
| 3 | 1 | 2 | AGCAGCGTG | TGGCA | GAGAGAGGG | X | X | | |
| 3 | 1 | 2 | AGCACCGTC | CCCGAG | GTGGGAGGA | X | X | | |
| 3 | 1 | 2 | AGCAGCTTC | CCATC | GGGTGAGGG | X | X | | |
| 3 | 1 | 2 | AGCAGCATC | TGTGGA | CAGTGAGGT | X | X | | |
| 3 | 1 | 2 | AGCAGCGTG | CTGGAT | GAGTGTGGT | X | X | | |
| 3 | 1 | 2 | AGCAGCGGC | AGGCAC | CAGTGAGGG | X | X | | |
| 3 | 1 | 2 | AGCAGGGTC | AGGGGT | GAGTGGGGT | X | X | | |
| 3 | 1 | 2 | AGCAGCGGC | GAACA | GAGCGGGGA | X | X | | |
| 3 | 1 | 2 | AGCTGCGTC | TCTGGG | AAGTGAGGG | X | X | | |
| 3 | 1 | 2 | AGCAGGGTC | ATGACA | GAGAGAGGG | X | X | | |
| 3 | 1 | 2 | AGCAGCATC | TGGCA | GAGTAAGGG | X | X | | |
| 3 | 1 | 2 | AGCAGTGTC | CACCT | GAGTTAGGT | X | X | | |
| 3 | 1 | 2 | AGCAGCGAC | GGCGG | GTGTGAGGC | X | X | | |
| 3 | 1 | 2 | AGCAGGGTC | ACACTA | AAGTGAGGC | X | X | | |
| 3 | 2 | 1 | AGCTGTGTC | ATGAC | AAGTGAGGA | X | X | | |
| 3 | 2 | 1 | AGCTGGGTC | ATGTG | AAGTGAGGA | X | X | | |
| 3 | 2 | 1 | AGCTGGGTC | ATGTG | AAGTGAGGA | X | X | | |
| 3 | 2 | 1 | GGCAGCGGC | CGGAAA | AAGTGAGGA | X | X | | |
| 3 | 2 | 1 | AGCATGGTC | AATGA | CAGTGAGGA | X | X | | |
| 3 | 2 | 1 | ATCAGCCTC | TTGTAG | GAGTGAGGG | X | X | | |
| 3 | 2 | 1 | AGCATGGTC | ATGAA | CAGTGAGGA | X | X | | |
| 3 | 2 | 1 | AGCAGGGGC | ATGAGA | GAGTGAGGT | X | X | | |
| 3 | 2 | 1 | AACAGCGTG | GCGGA | GAGTGAGGG | X | X | | |
| 3 | 2 | 1 | AACAGAGTC | CAGGAA | GAGTGAGGT | X | X | | |
| 3 | 2 | 1 | AACAGCATC | AGCTCT | GAGTGAGGC | X | X | | |
| 3 | 2 | 1 | ATCAGTGTC | AGTGAG | CAGTGAGGA | X | X | | |
| 3 | 2 | 1 | AGCAGCTGC | ATGAT | GAGTGAGGT | X | X | | |
| 3 | 2 | 1 | AGCAGGGTT | GATCA | GAGGGAGGA | X | X | | |
| 3 | 2 | 1 | AGCATAGTC | CAGAT | TAGTGAGGA | X | X | | |
| 3 | 2 | 1 | AGCAGCAAC | CTTAA | GAGTGAGGG | X | X | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 3 | 2 | 1 | AGCTACGTC | TAAGG | GAGAGAGGA | X | X | | |
| 3 | 2 | 1 | AGCAGCATT | GGTCCT | GAGTGAGGT | X | X | | |
| 3 | 2 | 1 | AGCATTGTC | ATGAA | GAGGGAGGA | X | X | | |
| 3 | 2 | 1 | AGCAGCACC | TGGCCT | GAGTGAGGG | X | X | | |
| 3 | 2 | 1 | AGCAGGGTT | GGGCA | GAGGGAGGA | X | X | | |
| 3 | 2 | 1 | AGTAGAGTC | TGACTA | AAGTGAGGA | X | X | | |
| 3 | 2 | 1 | AGCAACGTG | AGTGT | GAGCGAGGA | X | X | | |
| 3 | 2 | 1 | AGCAAGGTC | CCACT | CAGTGAGGA | X | X | | |
| 3 | 2 | 1 | AGCAGCCAC | AAGGT | GAGTGAGGG | X | X | | |
| 3 | 2 | 1 | AGCAATGTC | AGGGA | AAGTGAGGA | X | X | | |
| 3 | 2 | 1 | AGCAGCTAC | TCCAGA | GAGTGAGGT | X | X | | |
| 3 | 2 | 1 | AGCAGCTGC | AGCAG | GGGTGAGGA | X | X | | |
| 3 | 2 | 1 | AGCAGGGGC | AGCAT | GAGTGAGGT | X | X | | |
| 3 | 2 | 1 | AGCAACGTG | ACCTAC | TAGTGAGGA | X | X | | |
| 3 | 2 | 1 | AACAGCGTA | AGTAC | AAGTGAGGA | X | X | | |
| 3 | 2 | 1 | TGCACCGTC | AGTAA | CAGTGAGGA | X | X | | |
| 3 | 2 | 1 | AGCAGTGTG | TCCCAA | GAGTGAGGG | X | X | | |
| 3 | 2 | 1 | AGCAGCTGC | AATTAT | GAGAGAGGA | X | X | | |
| 3 | 2 | 1 | AGCACCTTC | TAGCTA | GAGTGAGCA | X | X | | |
| 3 | 2 | 1 | AGCAAGGTC | AGAAG | GAGTAAGGA | X | X | | |
| 3 | 2 | 1 | AGCTGCGTG | GGAGCA | GAGTGAGGC | X | X | | |
| 3 | 2 | 1 | AGCAAGGTC | CTAGT | GAGTGAAGA | X | X | | |
| 3 | 2 | 1 | AGCAGATTC | AGAAG | GAGTGAGGG | X | X | | |
| 3 | 2 | 1 | AGCAAAGTC | ATTAGA | GAGTAAGGA | X | X | | |
| 3 | 2 | 1 | TGCAGGGTC | TTCCC | GAGTGAGGG | X | X | | |
| 3 | 2 | 1 | AGCAGAATC | TTCTGG | GAGTGAGGT | X | X | | |
| 3 | 2 | 1 | AGCTGAGTC | CCTAGA | GAGGGAGGA | X | X | | |
| 3 | 2 | 1 | AGCATTGTC | CAGAAA | CAGTGAGGA | X | X | | |
| 3 | 2 | 1 | TGCAGGGTC | CCAGC | GAGTGAGGG | X | X | | |
| 3 | 2 | 1 | AGCAACTTC | ATGTAT | GAGTGTGGA | X | X | | |
| 3 | 2 | 1 | AGCAGCTGC | CTGCTG | GAGTGAGGG | X | X | | |
| 3 | 2 | 1 | AGCAGGGTT | GGGGA | GAGGGAGGA | X | X | | |
| 3 | 2 | 1 | AGCAAGGTC | ACTGA | GAGTAAGGA | X | X | | |
| 3 | 2 | 1 | AGCTGTGTC | AAAGG | AAGTGAGGA | X | X | | |
| 3 | 2 | 1 | AACAGCATC | TTAGGG | GAGTGAGGG | X | X | | |
| 3 | 2 | 1 | AGAAGCTTC | TAGGCT | GAGTGAGGC | X | X | | |
| 3 | 2 | 1 | AGCAGAGTT | TGGGGT | GAGTGAGAA | X | X | | |
| 3 | 2 | 1 | AGCAGAGTT | TGCTTT | GAGTGAGTA | X | X | | |
| 3 | 2 | 1 | AGGAGGGTC | TGAAGA | GAGTGAGGG | X | X | | |
| 3 | 2 | 1 | AGCAACTTC | AGCAAA | GTGTGAGGA | X | X | | |
| 3 | 2 | 1 | AGCAGCACC | CTGGA | GAGTGAGGG | X | X | | |
| 3 | 2 | 1 | AGCAAAGTC | TGGGAG | AAGTGAGGA | X | X | | |
| 3 | 2 | 1 | AGCAACGTG | ACCCCT | GAGTGGGGA | X | X | | |
| 3 | 2 | 1 | AGCAGGGTG | TATAA | GAGTGAGGG | X | X | | |
| 3 | 2 | 1 | AGCAGGTTC | TTGGGA | GAGTGAGGT | X | X | | |
| 3 | 2 | 1 | AGCAGCTTG | TTTCT | GAGTGAGGG | X | X | | |
| 3 | 2 | 1 | AGCAGTGTT | GCATTA | AAGTGAGGA | X | X | | |
| 3 | 2 | 1 | AGAGGCGTC | TGAGCA | GAGTGAGGA | X | X | | |
| 3 | 2 | 1 | AGCAGTGAC | TTAGGA | AAGTGAGGA | X | X | | |
| 3 | 2 | 1 | AGCACCTTC | CGAGT | GAGTGAGCA | X | X | | |
| 3 | 2 | 1 | ATCAGTGTC | TCCTC | CAGTGAGGA | X | X | | |
| 3 | 2 | 1 | AGCAGCAGC | AGGAA | GAGTGAGGC | X | X | | |
| 3 | 2 | 1 | AGCAGTGAC | ACCTG | AAGTGAGGA | X | X | | |
| 3 | 2 | 1 | AGCAGGGTT | CACAGG | GAGGGAGGA | X | X | | |
| 3 | 2 | 1 | AGCTGCGGC | AGGCCC | GAGTGAGGC | X | X | | |
| 3 | 2 | 1 | AGCAACATC | TGCTA | CAGTGAGGA | X | X | | |
| 3 | 2 | 1 | AGCAACGTA | TAATC | TAGTGAGGA | X | X | | |
| 3 | 2 | 1 | AGCAGGATC | GCCTGT | GAGTGAGGG | X | X | | |
| 3 | 2 | 1 | AGCAGCAAC | ATGGGA | GAGTGAGGT | X | X | | |
| 3 | 2 | 1 | AGTAGCGGC | TTCACA | GAGTGAGAA | X | X | | |
| 3 | 2 | 1 | AGCAGCAGC | ATCCT | GAGTGAGGG | X | X | | |
| 3 | 2 | 1 | AGCAGCTGC | CAGAA | GAGAGAGGA | X | X | | |
| 3 | 2 | 1 | AGCACCGTT | GTTAG | AAGTGAGGA | X | X | | |
| 3 | 2 | 1 | AGCAGGGTG | GTTAA | GAGTGAGGG | X | X | | |
| 3 | 2 | 1 | AGCTGGGTC | TTGGGA | AAGTGAGGA | X | X | | |
| 3 | 2 | 1 | ACCACCGTC | GCGGA | AAGTGAGGA | X | X | | |
| 3 | 2 | 1 | AGAAGCTTC | AGTTG | GAGTGAGGT | X | X | | |
| 3 | 2 | 1 | AGCAGAGGC | ACCTTT | GAGTGAGGT | X | X | | |
| 3 | 2 | 1 | AGCATCGTT | GAGCT | CAGTGAGGA | X | X | | |
| 3 | 2 | 1 | AGAAGCGTG | TGCTG | GAGTGAGGC | X | X | | |
| 3 | 2 | 1 | GACAGCGTC | TGGGAG | GTGTGAGGA | X | X | | |
| 3 | 2 | 1 | AGCAGAGAC | CTGCAT | GAGTGAGGG | X | X | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 3 | 2 | 1 | AGCAAAGTC | CTAAGG | AAGTGAGGA | X | X | | |
| 3 | 2 | 1 | AGCATTGTC | TCTAGA | GAATGAGGA | X | X | | |
| 3 | 2 | 1 | AGCAAAGTC | TTGAGA | GAGCGAGGA | X | X | | |
| 3 | 2 | 1 | AGCACAGTC | CCCGTT | GAGAGAGGA | X | X | | |
| 3 | 2 | 1 | AGCAGCAGC | ACTGA | GAGTGAGGC | X | X | | |
| 3 | 2 | 1 | AGCAGGGTG | GGGTGT | GAGTGAGGT | X | X | | |
| 3 | 2 | 1 | AGGAGCATC | GCGCAG | GAGTGAGGC | X | X | | |
| 3 | 2 | 1 | AGCTGGGTC | ATGTG | AAGTGAGGA | X | X | | |
| 3 | 2 | 1 | AGCTGTGTC | ATGAC | AAGTGAGGA | X | X | | |
| 3 | 2 | 1 | AGCTGTGTC | ATGAC | AAGTGAGGA | X | X | | |
| 3 | 2 | 1 | AGGAGCGTA | TCTTCT | GAGTGAGGC | X | X | | |
| 3 | 2 | 1 | AGCAGCCAC | AGCGA | GAGTGAGGG | X | X | | |
| 3 | 2 | 1 | AGCAGCATG | TGCAGG | GAGTGAGGC | X | X | | |
| 3 | 2 | 1 | AGCATTGTC | TTTTGA | GAGTGAGAA | X | X | | |
| 3 | 2 | 1 | AGCAGCCTG | GACGT | GAGTGAGGT | X | X | | |
| 3 | 2 | 1 | AGCAGCTCC | AGCGA | GAGTGAGGG | X | X | | |
| 3 | 2 | 1 | AGCAGCAGC | TAGGGA | GAGTGAGGC | X | X | | |
| 3 | 2 | 1 | AGCAACTTC | AATCAG | GAGTGTGGA | X | X | | |
| 3 | 2 | 1 | AGCAGAGTA | GCTTT | GAGTGAGGG | X | X | | |
| 3 | 2 | 1 | AGCAGCCTT | GTGTG | GAGTGAGGT | X | X | | |
| 3 | 2 | 1 | AGCAGTGTT | TCTGA | AAGTGAGGA | X | X | | |
| 3 | 2 | 1 | AGAAGCATC | TGTAT | GAGTGAGGC | X | X | | |
| 3 | 2 | 1 | AGCAGGGTA | AACAAA | GAGTGAGGT | X | X | | |
| 3 | 2 | 1 | AGCAGAGTT | AGGAGA | GAGTGAGGG | X | X | | |
| 3 | 2 | 1 | AGCAGAGGC | TGGGGA | GAGTGAGGG | X | X | | |
| 3 | 2 | 1 | AGCAACATC | TTATA | GAGTGAGCA | X | X | | |
| 3 | 2 | 1 | AGCAGAGTA | TGTCA | GAGTGAGGT | X | X | | |
| 3 | 2 | 1 | AGCATCGTT | GAGCT | GAGTGAAGA | X | X | | |
| 3 | 2 | 1 | AGAAGCTTC | CAGAAT | GAGTGAGGC | X | X | | |
| 3 | 2 | 1 | ATCAGCGGC | AGATGG | CAGTGAGGA | X | X | | |
| 3 | 2 | 1 | AGCAGAATC | TCTGG | GAGTGAGGC | X | X | | |
| 3 | 2 | 1 | AGCTACGTC | ACCTT | GAGGGAGGA | X | X | | |
| 3 | 2 | 1 | AGCAATGTC | AACAA | GAGTGAGAA | X | X | | |
| 3 | 2 | 1 | AGCATTGTC | ATGGTG | GAGGGAGGA | X | X | | |
| 3 | 2 | 1 | AGCAGAGGC | GGGAA | AAGTGAGGA | X | X | | |
| 3 | 2 | 1 | AGCACGGTC | GGGTAC | TAGTGAGGA | X | X | | |
| 3 | 2 | 1 | AGCAACATC | TATAT | GAGTGAGCA | X | X | | |
| 3 | 2 | 1 | AGCAGGGTT | GGAGT | GAGGGAGGA | X | X | | |
| 3 | 2 | 1 | AGCAGCTGC | AGCACC | GAGTGAGGG | X | X | | |
| 3 | 2 | 1 | AGCAGTGTG | TGGGAG | GAGTGAGGG | X | X | | |
| 3 | 2 | 1 | AACAGAGTC | TGGTT | GAGTGAGGC | X | X | | |
| 3 | 2 | 1 | GGCAGTGTC | TGGCA | AAGTGAGGA | X | X | | |
| 3 | 2 | 1 | AGCAGTGTG | TGGGAG | GAGTGAGGG | X | X | | |
| 3 | 2 | 1 | AGCAAGGTC | CAGACA | AAGTGAGGA | X | X | | |
| 3 | 2 | 1 | AGCAGTGTG | TGGGAG | GAGTGAGGG | X | X | | |
| 3 | 2 | 1 | AGCAGTGTG | TGGGAG | GAGTGAGGG | X | X | | |
| 3 | 2 | 1 | AGCAGTGTG | TGGGAG | GAGTGAGGG | X | X | | |
| 3 | 2 | 1 | AGCAGTGTG | TGGGAG | GAGTGAGGG | X | X | | |
| 3 | 2 | 1 | AGCAGCATG | AGAGG | GAGTGAGGG | X | X | | |
| 3 | 2 | 1 | AGCACTGTC | ATTAT | AAGTGAGGA | X | X | | |
| 3 | 2 | 1 | GGCAGTGTC | TGGAAA | AAGTGAGGA | X | X | | |
| 3 | 2 | 1 | CACAGCGTC | ACCCTG | GAGTGAGAA | X | X | | |
| 3 | 2 | 1 | AGCACCTTC | CTGGCT | GAGTGAGGG | X | X | | |
| 3 | 2 | 1 | AGCACAGTC | CCAAAT | GAGTGAGAA | X | X | | |
| 3 | 2 | 1 | AGCAGATTC | TGGTA | GAGTGAGGG | X | X | | |
| 3 | 2 | 1 | AGGAGGGTC | AGCCT | GAGTGAGGG | X | X | | |
| 3 | 2 | 1 | AGCAACGTG | GCGGG | AAGTGAGGA | X | X | | |
| 3 | 2 | 1 | AGCGGCGTT | GAGCTT | GAGTGAGGC | X | X | | |
| 3 | 2 | 1 | AGGAGTGTC | TGGGT | GAGTGAGGT | X | X | | |
| 3 | 2 | 1 | AGCTGCTTC | ACTGAT | GAGTGAGGC | X | X | | |
| 3 | 2 | 1 | AGCAACATC | CACTG | CAGTGAGGA | X | X | | |
| 3 | 2 | 1 | AGCATAGTC | GGACAA | TAGTGAGGA | X | X | | |
| 3 | 2 | 1 | AGCAACATC | AAACCT | GAGAGAGGA | X | X | | |
| 3 | 2 | 1 | GGCAGCGCC | CATCT | GAGTGAGGG | X | X | | |
| 3 | 2 | 1 | AGCAGAGTG | TCCAA | GAGTGAGGG | X | X | | |
| 3 | 2 | 1 | AGCAAAGTC | CTAGAT | GAGGGAGGA | X | X | | |
| 3 | 2 | 1 | GACAGCGTC | ACACA | CAGTGAGGA | X | X | | |
| 3 | 2 | 1 | AGCGGCGGC | TGGAT | GAGTGAGGG | X | X | | |
| 3 | 2 | 1 | AGCCGCATC | ATCAA | GAGTGAGGC | X | X | | |
| 3 | 2 | 1 | AGCAAAGTC | CCCAG | GAGGGAGGA | X | X | | |
| 3 | 2 | 1 | AGCAGGTTC | TAAGA | GAGTGAGGT | X | X | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 3 | 2 | 1 | AGCTGGGTC | ACACG | AAGTGAGGA | X | X | | |
| 3 | 2 | 1 | AGCAGAGAC | TGAATG | GAGTGAGGG | X | X | | |
| 3 | 2 | 1 | AGCAGAGGC | TTAAAG | GAGTGAGGG | X | X | | |
| 3 | 2 | 1 | AGCTGAGTC | TAGCCA | AAGTGAGGA | X | X | | |
| 3 | 2 | 1 | AGTAGAGTC | TTCCA | GAGTGAGAA | X | X | | |
| 3 | 2 | 1 | TGCAGCGAC | AACAG | GAGTGAGGT | X | X | | |
| 3 | 2 | 1 | AGCAGCTGC | CTCCG | GAGAGAGGA | X | X | | |
| 3 | 2 | 1 | AGCAGCATG | GCCCT | GAGTGAGGG | X | X | | |
| 3 | 2 | 1 | AGCTGAGTC | CCAAA | GAGTGAGAA | X | X | | |
| 3 | 2 | 1 | AGCAACATC | TGCTA | CAGTGAGGA | X | X | | |
| 3 | 2 | 1 | AGCAACATC | TGCTA | CAGTGAGGA | X | X | | |
| 3 | 2 | 1 | ACCAGCTTC | CTGCT | GAGTGAGGT | X | X | | |
| 3 | 2 | 1 | AGCAGCATT | ATTCT | GAGTGAGGG | X | X | | |
| 3 | 2 | 1 | AGGAGTGTC | GACAAG | GAGTGAGGG | X | X | | |
| 3 | 2 | 1 | AGAAGCGGC | TGCAG | GAGTGAGGG | X | X | | |
| 3 | 2 | 1 | AGCAGCCAC | AGACTA | GAGTGAGGC | X | X | | |
| 3 | 2 | 1 | AGCAGCAGC | AGCAG | GAGTGAGGC | X | X | | |
| 3 | 2 | 1 | AGCACAGTC | CGCAGG | GAGGGAGGA | X | X | | |
| 3 | 2 | 1 | AGCTGCGGC | GAATGA | GAGTGAGGG | X | X | | |
| 3 | 2 | 1 | AGCAAGGTC | TTATA | GGGTGAGGA | X | X | | |
| 3 | 2 | 1 | AGCACCTTC | TCCAT | GAGTGGGGA | X | X | | |
| 3 | 2 | 1 | AGCAGCATG | ATCCTG | GAGTGAGGC | X | X | | |
| 3 | 2 | 1 | AGCAAGGTC | AAGAGA | GAGTGAGCA | X | X | | |
| 3 | 2 | 1 | AGCATGGTC | AAAGCT | GAGTGAGAA | X | X | | |
| 3 | 2 | 1 | AGCAGCATG | ATCTTG | GAGTGAGGC | X | X | | |
| 3 | 2 | 1 | AGCAGGGTG | GGGTGT | GAGTGAGGT | X | X | | |
| 3 | 3 | 0 | AGAGGTGTC | GCCAT | GAGTGAGGA | X | X | | |
| 3 | 3 | 0 | GTCAGGGTC | ATCAG | GAGTGAGGA | X | X | | |
| 3 | 3 | 0 | TGCACTGTC | TCTCCC | GAGTGAGGA | X | X | | |
| 3 | 3 | 0 | TGCGGAGTC | GAGGGT | GAGTGAGGA | X | X | | |
| 3 | 3 | 0 | AGAAACGTT | CTTGCT | GAGTGAGGA | X | X | | |
| 3 | 3 | 0 | AGGAGCAAC | ATGCT | GAGTGAGGA | X | X | | |
| 3 | 3 | 0 | CGCTGTGTC | CCCGGG | GAGTGAGGA | X | X | | |
| 3 | 3 | 0 | AGCGTGGTC | ACTAGG | GAGTGAGGA | X | X | | |
| 3 | 3 | 0 | AGCAGGTCC | TTGAA | GAGTGAGGA | X | X | | |
| 3 | 3 | 0 | GGCTGTGTC | ATTCAG | GAGTGAGGA | X | X | | |
| 3 | 3 | 0 | TGCAGAGTT | AGAGGT | GAGTGAGGA | X | X | | |
| 3 | 3 | 0 | ATCATGGTC | AGAAAA | GAGTGAGGA | X | X | | |
| 3 | 3 | 0 | AGCAACGCG | GTGAGG | GAGTGAGGA | X | X | | |
| 3 | 3 | 0 | TGAAGTGTC | AGCTC | GAGTGAGGA | X | X | | |
| 3 | 3 | 0 | AGCAACTCC | GTCTT | GAGTGAGGA | X | X | | |
| 3 | 3 | 0 | AGAAATGTC | TTCCAG | GAGTGAGGA | X | X | | |
| 3 | 3 | 0 | GGCAGGGTA | TCACAG | GAGTGAGGA | X | X | | |
| 3 | 3 | 0 | AGCAACATG | GAGTT | GAGTGAGGA | X | X | | |
| 3 | 3 | 0 | GACAGCGTG | GCCAGT | GAGTGAGGA | X | X | | |
| 3 | 3 | 0 | GGCTGAGTC | ACTCT | GAGTGAGGA | X | X | | |
| 3 | 3 | 0 | TGCAGAGTT | TTGTG | GAGTGAGGA | X | X | | |
| 3 | 3 | 0 | AGCTGAGTG | CTGGAT | GAGTGAGGA | X | X | | |
| 3 | 3 | 0 | AACTGAGTC | TCTGA | GAGTGAGGA | X | X | | |
| 3 | 3 | 0 | AACATAGTC | TGTACA | GAGTGAGGA | X | X | | |
| 3 | 3 | 0 | AGCTGGGTG | ACAGT | GAGTGAGGA | X | X | | |
| 3 | 3 | 0 | AGCACCATA | TGGCT | GAGTGAGGA | X | X | | |
| 3 | 3 | 0 | ATCAGGTTC | CTTCT | GAGTGAGGA | X | X | | |
| 3 | 3 | 0 | ACCACGGTC | AGGTCT | GAGTGAGGA | X | X | | |
| 3 | 3 | 0 | ACCACGGTC | AGGTCT | GAGTGAGGA | X | X | | |
| 3 | 3 | 0 | ACCACGGTC | AGGTCT | GAGTGAGGA | X | X | | |
| 3 | 3 | 0 | ACCACGGTC | AGGTCT | GAGTGAGGA | X | X | | |
| 3 | 3 | 0 | ACCATGGTC | AAGTCT | GAGTGAGGA | X | X | | |
| 3 | 3 | 0 | AGAAACTTC | CTCTC | GAGTGAGGA | X | X | | |
| 3 | 3 | 0 | CACAGCTTC | TCACAG | GAGTGAGGA | X | X | | |
| 3 | 3 | 0 | ATCATGGTC | TTAGA | GAGTGAGGA | X | X | | |
| 3 | 3 | 0 | AGCAGTGAT | TGAGG | GAGTGAGGA | X | X | | |
| 3 | 3 | 0 | ACCAAGGTC | ACACT | GAGTGAGGA | X | X | | |
| 3 | 3 | 0 | AGCCCCTTC | CTAGAG | GAGTGAGGA | X | X | | |
| 3 | 3 | 0 | CTCAGTGTC | TAAGCA | GAGTGAGGA | X | X | | |
| 3 | 3 | 0 | AGTTGCTTC | CTGAG | GAGTGAGGA | X | X | | |
| 3 | 3 | 0 | AAGAGAGTC | TGAAA | GAGTGAGGA | X | X | | |
| 3 | 3 | 0 | GGCAGTGTG | GTCACC | GAGTGAGGA | X | X | | |
| 3 | 3 | 0 | TGCAGAGTT | GGGTCA | GAGTGAGGA | X | X | | |
| 3 | 3 | 0 | AGCCTCGTT | GCCAGA | GAGTGAGGA | X | X | | |
| 3 | 3 | 0 | ATCATCTTC | AAGTAA | GAGTGAGGA | X | X | | |
| 3 | 3 | 0 | AGTAGTGTG | TGAAGG | GAGTGAGGA | X | X | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 3 | 3 | 0 | AGCCTCGTG | TCCTCA | GAGTGAGGA | X | X | | |
| 3 | 3 | 0 | AAAAGCGTT | TGGGAA | GAGTGAGGA | X | X | | |
| 3 | 3 | 0 | ACTAGAGTC | CCCCAA | GAGTGAGGA | X | X | | |
| 3 | 3 | 0 | GGCGGCGGC | GAAGG | GAGTGAGGA | X | X | | |
| 3 | 3 | 0 | ATGAGAGTC | CTGGG | GAGTGAGGA | X | X | | |
| 3 | 3 | 0 | AGCACAGTG | GCCTGA | GAGTGAGGA | X | X | | |
| 3 | 3 | 0 | TACAGGGTC | CTCGGT | GAGTGAGGA | X | X | | |
| 3 | 3 | 0 | AGCAGAGGT | GCTGA | GAGTGAGGA | X | X | | |
| 3 | 3 | 0 | GGAAGAGTC | CAGGG | GAGTGAGGA | X | X | | |
| 3 | 3 | 0 | GGAAGAGTC | CAGGG | GAGTGAGGA | X | X | | |
| 3 | 3 | 0 | AGTGGGGTC | TGTTGG | GAGTGAGGA | X | X | | |
| 3 | 3 | 0 | ATGAGGGTC | ACTGAG | GAGTGAGGA | X | X | | |
| 3 | 3 | 0 | GTCAGAGTC | CTAGG | GAGTGAGGA | X | X | | |
| 3 | 3 | 0 | GCCAGGGTC | TGGGAG | GAGTGAGGA | X | X | | |
| 3 | 3 | 0 | AGCAACTCC | ATCTT | GAGTGAGGA | X | X | | |
| 3 | 3 | 0 | AGGGGAGTC | GACAG | GAGTGAGGA | X | X | | |
| 3 | 3 | 0 | GTCAGGGTC | ATCAG | GAGTGAGGA | X | X | | |
| 3 | 3 | 0 | GTCAGGGTC | ATCAG | GAGTGAGGA | X | X | | |
| 3 | 3 | 0 | AGCATAGTA | GTTAA | GAGTGAGGA | X | X | | |
| 3 | 3 | 0 | GTCAGAGTC | CAAAA | GAGTGAGGA | X | X | | |
| 3 | 3 | 0 | GGCAGTGTT | ACAAA | GAGTGAGGA | X | X | | |
| 3 | 3 | 0 | GCCATCGTC | ACCCA | GAGTGAGGA | X | X | | |
| 3 | 3 | 0 | CTCAGTGTC | GAGAGA | GAGTGAGGA | X | X | | |
| 3 | 3 | 0 | GGAAGAGTC | AAGGGA | GAGTGAGGA | X | X | | |
| 3 | 3 | 0 | AGCAACTCC | AGAAGA | GAGTGAGGA | X | X | | |
| 3 | 3 | 0 | AGCCTCGGC | GGCCCT | GAGTGAGGA | X | X | | |
| 3 | 3 | 0 | GACAGGGTC | ACTTTA | GAGTGAGGA | X | X | | |
| 3 | 3 | 0 | AGAATAGTC | CTGGG | GAGTGAGGA | X | X | | |
| 3 | 3 | 0 | AGTAGAGTA | GTAAAG | GAGTGAGGA | X | X | | |
| 3 | 3 | 0 | GGGAGGGTC | GGTCAG | GAGTGAGGA | X | X | | |
| 3 | 3 | 0 | AACAGGGTT | ATCCA | GAGTGAGGA | X | X | | |
| 3 | 3 | 0 | GCCAGGGTC | ACCCA | GAGTGAGGA | X | X | | |
| 3 | 3 | 0 | GGAAGAGTC | TTACCT | GAGTGAGGA | X | X | | |
| 3 | 3 | 0 | AGTGGAGTC | ACCGTA | GAGTGAGGA | X | X | | |
| 3 | 3 | 0 | GCCAGAGTC | ACCCTT | GAGTGAGGA | X | X | | |
| 3 | 3 | 0 | GGCAGTGTA | ACTTAA | GAGTGAGGA | X | X | | |
| 3 | 3 | 0 | CTCAGTGTC | GTTGT | GAGTGAGGA | X | X | | |
| 3 | 3 | 0 | AGATGGGTC | TACAGA | GAGTGAGGA | X | X | | |
| 3 | 3 | 0 | GCCAGAGTC | TGAGTG | GAGTGAGGA | X | X | | |
| 3 | 3 | 0 | AGTAGGGTT | TGAAT | GAGTGAGGA | X | X | | |
| 3 | 3 | 0 | CACTGCGTC | CTTGGT | GAGTGAGGA | X | X | | |
| 3 | 3 | 0 | AACTGGGTC | CCTGAG | GAGTGAGGA | X | X | | |
| 3 | 3 | 0 | AGTAACATC | AGTAGT | GAGTGAGGA | X | X | | |
| 3 | 3 | 0 | GACAGAGTC | CACAGA | GAGTGAGGA | X | X | | |
| 3 | 3 | 0 | ATCAGGTTC | CAATA | GAGTGAGGA | X | X | | |
| 3 | 3 | 0 | AGCATGGTA | GTGGG | GAGTGAGGA | X | X | | |
| 3 | 3 | 0 | AGCAACTGC | CCTTCT | GAGTGAGGA | X | X | | |
| 3 | 3 | 0 | GGCTGAGTC | TTGCAG | GAGTGAGGA | X | X | | |
| 3 | 3 | 0 | AGCAGCCCA | GGGGGT | GAGTGAGGA | X | X | | |
| 3 | 3 | 0 | AGCAAAGTG | TCAAT | GAGTGAGGA | X | X | | |
| 3 | 3 | 0 | AGAAAAGTC | CACAGG | GAGTGAGGA | X | X | | |
| 3 | 3 | 0 | AACAACTTC | TCCTG | GAGTGAGGA | X | X | | |
| 3 | 3 | 0 | TGCGGAGTC | CCTGGG | GAGTGAGGA | X | X | | |
| 3 | 3 | 0 | AGAATGGTC | TCTGAT | GAGTGAGGA | X | X | | |
| 3 | 3 | 0 | AGCAGCAGA | ACAACT | GAGTGAGGA | X | X | | |
| 3 | 3 | 0 | AGCAGCAGA | TATTG | GAGTGAGGA | X | X | | |
| 3 | 3 | 0 | AGTTGCTTC | TTCTAA | GAGTGAGGA | X | X | | |
| 3 | 3 | 0 | GACAGGGTC | CTGGA | GAGTGAGGA | X | X | | |
| 3 | 3 | 0 | GGAAGAGTC | CGGGG | GAGTGAGGA | X | X | | |
| 3 | 3 | 0 | GGAAGAGTC | CAAAG | GAGTGAGGA | X | X | | |
| 3 | 3 | 0 | AGGGGGGTC | AAGAGT | GAGTGAGGA | X | X | | |
| 3 | 3 | 0 | AACAACTTC | CATGT | GAGTGAGGA | X | X | | |
| 3 | 3 | 0 | ACCAAGGTC | AGCAGG | GAGTGAGGA | X | X | | |
| 3 | 3 | 0 | GGCCACGTC | GCACAG | GAGTGAGGA | X | X | | |
| 3 | 3 | 0 | AGCAAGGTT | AGGAAG | GAGTGAGGA | X | X | | |
| 3 | 3 | 0 | AGTAGGGTT | GGAGGG | GAGTGAGGA | X | X | | |
| 4 | 0 | 4 | AGCAGCGTC | ACAAAA | TAGCAAGGT | X | X | | |
| 4 | 0 | 4 | AGCAGCGTC | AAGGG | GAGACAAGT | X | X | | |
| 4 | 0 | 4 | AGCAGCGTC | CGTCCC | GAGAGGCGC | X | X | | |
| 4 | 1 | 3 | AGCAGCGGC | CTAGC | GGGTGAGTC | X | X | | |
| 4 | 1 | 3 | AGCAGCGTT | GCTAT | GAGAAAGGT | X | X | | |
| 4 | 1 | 3 | AGCAACGTC | ATGTGC | TGGGGAGGA | X | X | | |

| # of mutations T | (-)(+) | (-) site | spacer | (+) site | 4 nM | 2 nM | 1 nM | 0.5 nM |
|---|---|---|---|---|---|---|---|---|
| 4 | 1 | 3 | AGCAGCGGC | CGGAG | AAGTGTGGG | X | X | | |
| 4 | 1 | 3 | AGCAACGTC | TGTTT | GTGTAAGGC | X | X | | |
| 4 | 1 | 3 | AGCAACGTC | ACCTG | GAGTCACGC | X | X | | |
| 4 | 1 | 3 | AGCAGTGTC | ATGATG | GTGTGTGAA | X | X | | |
| 4 | 1 | 3 | AGCAGCGGC | CACATA | GTGTGTGAA | X | X | | |
| 4 | 1 | 3 | AGCAACGTC | CAGTCC | AAGTGTGGC | X | X | | |
| 4 | 1 | 3 | AGCAACGTC | GGATGC | AGGTGAGCA | X | X | | |
| 4 | 1 | 3 | ATCAGCGTC | CAGATG | GTGTGAGTC | X | X | | |
| 4 | 1 | 3 | AGCAACGTC | CTTAC | TAGTGAATA | X | X | | |
| 4 | 1 | 3 | AGCAACGTC | GTGAC | GTGCGATGA | X | X | | |
| 4 | 1 | 3 | AGCAGTGTC | TGTCTG | GAGTGTTGC | X | X | | |
| 4 | 1 | 3 | AGCAGCGTT | GTTTTG | ATGTGAGGC | X | X | | |
| 4 | 1 | 3 | AGCAACGTC | TGTGT | GAGTGACAG | X | X | | |
| 4 | 1 | 3 | AGCACCGTC | TGCCG | GTGTGCGGT | X | X | | |
| 4 | 1 | 3 | AGCAACGTC | CAGTCC | AAGTGTGGC | X | X | | |
| 4 | 2 | 2 | AGCATTGTC | TTGTGG | GAGTAAGGC | X | X | | |
| 4 | 2 | 2 | AGCAGCGAT | GGGGTT | GAGTGAGAC | X | X | | |
| 4 | 2 | 2 | AGCTGTGTC | ATCCAT | GAGTGAGTC | X | X | | |
| 4 | 2 | 2 | AGCATGGTC | AAGTTC | TAGTGAGGG | X | X | | |
| 4 | 2 | 2 | AGCATCTTC | ATATG | GAGTGAGAG | X | X | | |
| 4 | 2 | 2 | AGCATGGTC | AGGTTC | TAGTGAGGG | X | X | | |
| 4 | 2 | 2 | AGCATAGTC | AAGGG | GAGTGAGAG | X | X | | |
| 4 | 2 | 2 | AGCATGGTC | TCTTTC | GAGTGAGGG | X | X | | |
| 4 | 2 | 2 | AGCATGGTC | AGGTTC | TAGTGAGGG | X | X | | |
| 4 | 2 | 2 | AGCATAGTC | TTTATT | GAGTGAGAG | X | X | | |
| 4 | 2 | 2 | AGCAAAGTC | CTGAAG | GAGTGAGAG | X | X | | |
| 4 | 2 | 2 | AGCAGCGCA | AAGCAC | GTGTGAGGC | X | X | | |
| 4 | 2 | 2 | ATCAACGTC | TGGAC | TAGTGAGGG | X | X | | |
| 4 | 2 | 2 | AGTAGTGTC | CACAG | AAGTGAGGG | X | X | | |
| 4 | 2 | 2 | AGCAAAGTC | CCTTG | GAGTGAGTG | X | X | | |
| 4 | 2 | 2 | AGCCACGTC | TATGCT | TTGTGAGGA | X | X | | |
| 4 | 2 | 2 | AGCATGGTC | GGGTTC | TAGTGAGGG | X | X | | |
| 4 | 2 | 2 | AGCAGAGTT | GGGAAA | AAGTGAGGG | X | X | | |
| 4 | 2 | 2 | AGCATTGTC | ACTGT | GAGTGAGAG | X | X | | |
| 4 | 2 | 2 | AGCATGGTC | AGGTTC | TAGTGAGGG | X | X | | |
| 4 | 2 | 2 | AGCATGGTC | AGGTTC | TAGTGAGGG | X | X | | |
| 4 | 2 | 2 | AGCATGGTC | TAGCA | GAGTGAGTC | X | X | | |
| 4 | 2 | 2 | AGCTGTGTC | ATCCAT | GAGTGAGTC | X | X | | |
| 4 | 2 | 2 | AGTAGAGTC | TGGGTG | GAGTGAGAC | X | X | | |
| 4 | 2 | 2 | AGCATGGTC | AGGTTC | TAGTGAGGG | X | X | | |
| 4 | 2 | 2 | AGCTGTGTC | CAGGAG | GAGTGAGTC | X | X | | |
| 4 | 2 | 2 | AGCAACTTC | TGATC | TAGTGAGGT | X | X | | |
| 4 | 2 | 2 | AGCTGAGTC | AACCT | GAGTAAGGG | X | X | | |
| 4 | 2 | 2 | AGTAGGGTC | ATCAG | AAGTGAGGT | X | X | | |
| 4 | 2 | 2 | AGCTGTGTC | ACCTT | GAGTGAGTC | X | X | | |
| 4 | 2 | 2 | AGCAACATC | TGGAA | GAGTGAGAG | X | X | | |
| 4 | 2 | 2 | AGCATCGTG | TTTGA | AAGTGAGGC | X | X | | |
| 4 | 2 | 2 | AGCATGGTC | AGGTTC | TAGTGAGGG | X | X | | |
| 4 | 2 | 2 | AGCAACTTC | AGGGG | AAGTGAGGG | X | X | | |
| 4 | 2 | 2 | AGCATGGTC | AGATTA | TAGTGAGGG | X | X | | |
| 4 | 2 | 2 | AGCATGGTC | CGTGTC | TAGTGAGGG | X | X | | |
| 4 | 2 | 2 | AGCAAGGTC | ACCTGA | GAGTGAGAG | X | X | | |
| 4 | 2 | 2 | AGCATGGTC | AAGTTC | TAGTGAGGG | X | X | | |
| 4 | 2 | 2 | AGCAGGGTA | TAGGG | GAGTGAGAT | X | X | | |
| 4 | 2 | 2 | GGCAGAGTC | CAAGCA | GAGTGAGAG | X | X | | |
| 4 | 2 | 2 | AGTAACGTC | AAAGGT | GAGTGAAAA | X | X | | |
| 4 | 2 | 2 | AGCATGGTC | AATTTC | TAGTGAGGG | X | X | | |
| 4 | 2 | 2 | AGCAGTGTG | GAGTG | GAGTGAGAG | X | X | | |
| 4 | 2 | 2 | AGCACCATC | CCCAT | GAGTGAGTC | X | X | | |
| 4 | 2 | 2 | AGCAACGTG | AGACAG | TAGTGAGAA | X | X | | |
| 4 | 2 | 2 | AGCAACGGC | CCTGGG | CAGTGAGGG | X | X | | |
| 4 | 2 | 2 | AGTAGAGTC | ATGGA | GAGTGAGAG | X | X | | |
| 4 | 2 | 2 | GGCACCGTC | GCTGA | GAGTGAGTC | X | X | | |
| 4 | 2 | 2 | AGCATGGTC | AGGTTC | TAGTGAGGG | X | X | | |
| 4 | 2 | 2 | AGCATAGTC | AGGTTC | TAGTGAGGG | X | X | | |
| 4 | 2 | 2 | AGTAACGTC | TCCCT | GAGTGTGGG | X | X | | |
| 4 | 3 | 1 | AGCATAGTG | GTTAG | GAGTGAGGG | X | X | | |
| 4 | 3 | 1 | ATCAGGGTG | GGTAG | GAGTGAGGC | X | X | | |
| 4 | 3 | 1 | TACAGAGTC | TCCAG | GAGTGAGGG | X | X | | |
| 4 | 3 | 1 | ATGAGGGTC | TCATA | GAGTGAGGT | X | X | | |
| 4 | 3 | 1 | AGCAAATTC | TTCAG | GAGTGAGGT | X | X | | |

-continued

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 4 | 3 | 1 | AGCAAAGTG | CTCAAA | GAGTGAGGC | X | X | | |
| 4 | 3 | 1 | ATAAGTGTC | ATTGAA | GAGTGAGGC | X | X | | |
| 4 | 3 | 1 | AGTAGTCTC | TTGAT | GAGTGAGGG | X | X | | |
| 4 | 3 | 1 | CGCAGCAAC | AGCGGT | GAGTGAGGG | X | X | | |
| 4 | 3 | 1 | AGCAATGTG | TGCTT | GAGTGAGGC | X | X | | |
| 4 | 3 | 1 | ACCAAAGTC | TTTGAT | GAGTGAGGG | X | X | | |
| 4 | 3 | 1 | AGTAGTGTT | TCAAGA | GAGTGAGGC | X | X | | |
| 4 | 3 | 1 | AGCATAGTG | GGGTAG | GAGTGAGGG | X | X | | |
| 4 | 3 | 1 | ATCACCATC | CTAAGT | GAGTGAGGG | X | X | | |
| 4 | 3 | 1 | AGAATCGTT | TGAAA | GAGTGAGGG | X | X | | |
| 4 | 3 | 1 | AGTAACATC | GGAAAA | GAGTGAGGT | X | X | | |
| 4 | 3 | 1 | AGGACAGTC | AGTTG | GAGTGAGGT | X | X | | |
| 4 | 3 | 1 | GGCAGTGTT | GACAG | GAGTGAGGC | X | X | | |
| 4 | 3 | 1 | AGTTGTGTC | GTTTT | GAGTGAGGT | X | X | | |
| 4 | 3 | 1 | CCCACCGTC | CCGCCC | GAGTGAGGG | X | X | | |
| 4 | 3 | 1 | AGTACCGGC | TTCACA | GAGTGAGGT | X | X | | |
| 4 | 3 | 1 | AGCAACTTT | GGAATG | GAGTGAGGG | X | X | | |
| 4 | 3 | 1 | AGCAAGGGC | AGTGA | GAGTGAGGC | X | X | | |
| 4 | 3 | 1 | GTCAGGGTC | ATAAGA | GAGTGAGGC | X | X | | |
| 4 | 3 | 1 | AGGAAAGTC | TAACA | GAGTGAGGT | X | X | | |
| 4 | 3 | 1 | CACAGTGTC | AGGCT | GAGTGAGGT | X | X | | |
| 4 | 3 | 1 | GTCAGTGTC | CAAGAA | GAGTGAGGT | X | X | | |
| 4 | 3 | 1 | ATCACCATC | CAGAGA | GAGTGAGGT | X | X | | |
| 4 | 3 | 1 | ATCAACATC | TTTGG | GAGTGAGGC | X | X | | |
| 4 | 3 | 1 | CCGAGCGTC | TGAAA | GAGTGAGGT | X | X | | |
| 4 | 3 | 1 | AGCACAGTG | AGCACT | GAGTGAGGG | X | X | | |
| 4 | 3 | 1 | AACATTGTC | TAAGG | GAGTGAGGT | X | X | | |
| 4 | 3 | 1 | AACATTGTC | TAAGG | GAGTGAGGT | X | X | | |
| 4 | 3 | 1 | AACATTGTC | TAAGG | GAGTGAGGT | X | X | | |
| 4 | 3 | 1 | AGTACCGGC | ATCCAT | GAGTGAGGT | X | X | | |
| 4 | 3 | 1 | AGTACAGTC | TCTGTT | GAGTGAGAA | X | X | | |
| 4 | 3 | 1 | AACAACATC | ACGGG | GAGTGAGGT | X | X | | |
| 4 | 3 | 1 | TCCCGCGTC | CGGGAA | GAGTGAGGT | X | X | | |
| 4 | 3 | 1 | AGGGGAGTC | AGATGC | GAGTGAGGG | X | X | | |
| 4 | 3 | 1 | AGTAGCTGC | GGCCA | GAGTGAGGC | X | X | | |
| 4 | 3 | 1 | GGAAGGGTC | AGTGC | GAGTGAGGG | X | X | | |
| 4 | 3 | 1 | GGAAGGGTC | AGTGC | GAGTGAGGG | X | X | | |
| 4 | 3 | 1 | GGAAGGGTC | AGTGC | GAGTGAGGG | X | X | | |
| 4 | 3 | 1 | GGAAGGGTC | AGTGC | GAGTGAGGG | X | X | | |
| 4 | 3 | 1 | GGAAGGGTC | AGTGC | GAGTGAGGG | X | X | | |
| 4 | 3 | 1 | CTCAGTGTC | TCCCA | GAGTGAGGC | X | X | | |
| 4 | 3 | 1 | AGTAAAGTC | ACAAG | GAGTGAGGT | X | X | | |
| 4 | 3 | 1 | AACGGGGTC | TGGGA | GAGTGAGGT | X | X | | |
| 4 | 3 | 1 | GGGAGGGTC | CCCAT | GAGTGAGGG | X | X | | |
| 4 | 3 | 1 | GGCAGGGTT | AAGATT | GAGTGAGGC | X | X | | |
| 4 | 3 | 1 | AGGGGAGTC | TGAGGG | GAGTGAGGG | X | X | | |
| 4 | 3 | 1 | AACAATGTC | ATGTT | GAGTGAGGG | X | X | | |
| 4 | 3 | 1 | AGCTTGGTC | TGGCT | GAGTGAGGT | X | X | | |
| 4 | 3 | 1 | ATGAGGGTC | TCATA | GAGTGAGGT | X | X | | |
| 4 | 3 | 1 | GCCAGTGTC | TCTTAG | GAGTGAGGT | X | X | | |
| 4 | 3 | 1 | ATCACAGTC | TCTGG | GAGTGAGGC | X | X | | |
| 4 | 3 | 1 | GACAGGGTC | TTAAT | GAGTGAGGC | X | X | | |
| 4 | 3 | 1 | AGCCTTGTC | GTAACT | GAGTGAGGT | X | X | | |
| 4 | 3 | 1 | GGCAGCGGT | GTTCA | GAGTGAGGG | X | X | | |
| 4 | 3 | 1 | TCCAGTGTC | TATGG | GAGTGAGGC | X | X | | |
| 4 | 3 | 1 | AGCAGCTGT | GATGT | GAGTGAGGG | X | X | | |
| 4 | 3 | 1 | AGCAGCTCA | CATGG | GAGTGAGGT | X | X | | |
| 4 | 3 | 1 | GGCAACGGC | ACACA | GAGGGAGGA | X | X | | |
| 4 | 3 | 1 | AGCTGAGTT | AAGCA | GAGTGAGGT | X | X | | |
| 4 | 3 | 1 | AGCAGCACA | AAGCTG | GAGTGAGGG | X | X | | |
| 4 | 3 | 1 | AGCAACCTT | GAGAT | GAGTGAGGC | X | X | | |
| 4 | 3 | 1 | AGCAAATTC | GGGCCC | GAGTGAGGT | X | X | | |
| 4 | 3 | 1 | AGACGGGTC | GGCCC | GAGTGAGGT | X | X | | |
| 4 | 3 | 1 | GCCAGAGTC | TGCACA | GAGTGAGGG | X | X | | |
| 4 | 3 | 1 | AGCAACAGC | ATTGG | GAGTGAGGG | X | X | | |
| 4 | 3 | 1 | AACCGAGTC | ACTCAA | GAGTGAGGG | X | X | | |
| 4 | 3 | 1 | AGCAGCTCA | CCAGCA | GAGTGAGGT | X | X | | |
| 4 | 3 | 1 | GGAAGGGTC | CTGTGT | GAGTGAGGG | X | X | | |
| 4 | 3 | 1 | AGAACGGTC | CAGCA | GAGTGAGGC | X | X | | |
| 4 | 3 | 1 | AGCAAGGTA | AGGAA | AAGTGAGGA | X | X | | |
| 4 | 3 | 1 | AGAATGGTC | AGTGGG | GAGTGAGGG | X | X | | |

| # of mutations | | | | | | | VF2468 concentration | | | |
|---|---|---|---|---|---|---|---|---|---|---|
| T | (−) | (+) | (−) site | spacer | (+) site | 4 nM | 2 nM | 1 nM | 0.5 nM |
| 4 | 3 | 1 | AGAATGGTC | CAAAT | GAGTGAGGG | X | X | | |
| 4 | 3 | 1 | AGCAAGGGC | TCCGT | GAGTGAGGG | X | X | | |
| 4 | 3 | 1 | TGCTGAGTC | TCCATG | GAGTGAGGG | X | X | | |
| 4 | 3 | 1 | AGCATTGTT | TCTGGG | GAGTGAGGG | X | X | | |
| 4 | 3 | 1 | AGCATTGTG | GTGAG | GAGTGAGGG | X | X | | |
| 4 | 3 | 1 | GCTAGCGTC | CATGG | GAGTGAGGC | X | X | | |
| 4 | 3 | 1 | AGCAACTTT | CCACTG | GAGTGAGGC | X | X | | |
| 4 | 3 | 1 | AGTAGGGTT | GGTGG | GAGTGAGGC | X | X | | |
| 4 | 3 | 1 | GGCAGTGTT | TCCCAG | GAGTGAGGC | X | X | | |
| 4 | 3 | 1 | AACTGAGTC | TCTGG | GAGTGAGGT | X | X | | |
| 4 | 3 | 1 | AGCATTGTG | ATGAG | GAGTGAGGG | X | X | | |
| 4 | 3 | 1 | AGCAAGGTT | TATGT | GAGTGAGCA | X | X | | |
| 4 | 3 | 1 | GGCAACGTT | TGTAT | GAGTGAGGT | X | X | | |
| 4 | 3 | 1 | AACAACCTC | GCCTAT | GAGTGAGGG | X | X | | |
| 4 | 3 | 1 | AGGGACGTC | CAAGG | GAGTGAGGG | X | X | | |
| 4 | 3 | 1 | TCCAGTGTC | ACATCA | GAGTGAGGC | X | X | | |
| 4 | 3 | 1 | AGCATGGTT | GGAGTA | GAGTGAGGG | X | X | | |
| 4 | 3 | 1 | AATAGGGTC | AAAAT | GAGTGAGGT | X | X | | |
| 4 | 3 | 1 | AGTATAGTC | TTTAGG | GAGTGAGGC | X | X | | |
| 4 | 3 | 1 | TGCAATGTC | CTTGG | GAGTGAGGC | X | X | | |
| 4 | 3 | 1 | AGCTACATC | TACAGG | GAGTGAGGG | X | X | | |
| 4 | 3 | 1 | AGCAAAGTA | AAGAGA | GAGTGAGGC | X | X | | |
| 4 | 4 | 0 | CACCCCGTC | TACCTG | GAGTGAGGA | X | X | | |
| 4 | 4 | 0 | AGGCACGTT | AGGCA | GAGTGAGGA | X | X | | |
| 4 | 4 | 0 | CACCCCGTC | GACGTC | GAGTGAGGA | X | X | | |
| 4 | 4 | 0 | GCAAGAGTC | TGGCT | GAGTGAGGA | X | X | | |
| 4 | 4 | 0 | AGTGCAGTC | CCTTA | GAGTGAGGA | X | X | | |
| 4 | 4 | 0 | ATCCACGTT | ATGCTG | GAGTGAGGA | X | X | | |
| 4 | 4 | 0 | ATCCACGTT | TTGGG | GAGTGAGGA | X | X | | |
| 3 | 1 | 2 | AGCAGCTTC | TGCCAT | GAGTGAAGT | X | | X | |
| 3 | 1 | 2 | AGCAGGGTC | TGCAGT | GAGAGAGGC | X | | X | |
| 3 | 1 | 2 | AGCAGCTTC | CAGGA | GAGTGAAGT | X | | X | |
| 3 | 1 | 2 | AGCAGGGTC | TGTTTT | GAGTGAGTT | X | | X | |
| 4 | 3 | 1 | AGCAACTGC | ATTTT | GAGTGAGGG | X | | X | |
| 4 | 3 | 1 | AGCAACTGC | ATCTT | GAGTGAGGG | X | | X | |
| 3 | 1 | 2 | AGCAGCTTC | CCAAAA | ATGTGAGGA | X | | | X |
| 3 | 3 | 0 | AGGTGCCTC | CCCATG | GAGTGAGGA | X | | | X |
| 5 | 3 | 2 | AGCTCAGTC | CACAG | GAGTGAGTC | X | | | X |
| 2 | 1 | 1 | AGCAGCGTG | CAGAA | GAGAGAGGA | X | | | |
| 2 | 1 | 1 | AGCAGCGTG | GATGGA | GAGAGAGGA | X | | | |
| 2 | 1 | 1 | AGCAGCGTG | GATGGA | GAGAGAGGA | X | | | |
| 2 | 1 | 1 | AGCAGCGTG | GATGGA | GAGAGAGGA | X | | | |
| 2 | 1 | 1 | AGCAGCCTC | TGCCAG | GGGTGAGGA | X | | | |
| 2 | 1 | 1 | AGCAGCCTC | CCATA | GAGGGAGGA | X | | | |
| 2 | 1 | 1 | AGGAGCGTC | CCTTGG | GAGTGATGA | X | | | |
| 2 | 1 | 1 | AGCAGCGAC | AGCCA | GAGTGACGA | X | | | |
| 2 | 1 | 1 | AGCTGCGTC | CTGTA | GCGTGAGGA | X | | | |
| 2 | 1 | 1 | AGCAGGGTC | TGCCT | GAGTCAGGA | X | | | |
| 2 | 1 | 1 | AGCAGCATC | TGGGA | GAATGAGGA | X | | | |
| 2 | 1 | 1 | AGGAGCGTC | CAGTGC | GACTGAGGA | X | | | |
| 2 | 1 | 1 | AGCAGCGTG | GATGGA | GAGAGAGGA | X | | | |
| 2 | 1 | 1 | AGCAGCGTG | GATGGA | GAGAGAGGA | X | | | |
| 2 | 1 | 1 | AGCAGCATC | ACAGAC | GCGTGAGGA | X | | | |
| 2 | 1 | 1 | ACCAGCGTC | TGCTTT | GGGTGAGGA | X | | | |
| 2 | 1 | 1 | AGCAGGGTC | ATTGA | GAATGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AGGAGCGAC | GGGGG | GAGTGAGGA | X | | | |
| 2 | 2 | 0 | AACAGCCTC | CTTCC | GAGTGAGGA | X | | | |
| 2 | 2 | 0 | AGAAGCATC | CGAAGG | GAGTGAGGA | X | | | |
| 2 | 2 | 0 | AGAAGCCTC | CATTCC | GAGTGAGGA | X | | | |
| 3 | 0 | 3 | AGCAGCGTC | AGGGG | AAATTAGGA | X | | | |
| 3 | 0 | 3 | AGCAGCGTC | TTGGAA | GACCGAGGT | X | | | |
| 3 | 0 | 3 | AGCAGCGTC | CTGTG | GCGTGGCGA | X | | | |
| 3 | 0 | 3 | AGCAGCGTC | TCAGCG | GGTGGAGGA | X | | | |
| 3 | 0 | 3 | AGCAGCGTC | CGCCGA | GAGTCAGCC | X | | | |
| 3 | 0 | 3 | AGCAGCGTC | AGGGAG | AAGTCAGGT | X | | | |
| 3 | 0 | 3 | AGCAGCGTC | AACAGT | GCCTGATGA | X | | | |
| 3 | 0 | 3 | AGCAGCGTC | AGTAGA | GACAGAGAA | X | | | |
| 3 | 0 | 3 | AGCAGCGTC | GGGTGG | GTTTGGGGA | X | | | |
| 3 | 0 | 3 | AGCAGCGTC | TCCGAA | GAGACAGCA | X | | | |
| 3 | 0 | 3 | AGCAGCGTC | CCGAG | GAGCTGGGA | X | | | |
| 3 | 0 | 3 | AGCAGCGTC | CGGCC | GCGGCAGGA | X | | | |
| 3 | 0 | 3 | AGCAGCGTC | CGGCC | GCGGCAGGA | X | | | |
| 3 | 0 | 3 | AGCAGCGTC | ACTCCC | AAGCGAGTA | X | | | |
| 3 | 0 | 3 | AGCAGCGTC | CCCTG | CAGAGAGCA | X | | | |
| 3 | 0 | 3 | AGCAGCGTC | TCTCTG | GGCTGGGGA | X | | | |
| 3 | 0 | 3 | AGCAGCGTC | CAGGAG | GGCTGGGGA | X | | | |
| 3 | 0 | 3 | AGCAGCGTC | AGGGTG | GAGTCATGT | X | | | |
| 3 | 0 | 3 | AGCAGCGTC | TGATTG | GCGGGGGA | X | | | |
| 3 | 0 | 3 | AGCAGCGTC | TGGGG | AATTGGGGA | X | | | |
| 3 | 0 | 3 | AGCAGCGTC | CGCCGA | GAGTCAGCC | X | | | |
| 3 | 1 | 2 | AGCAGTGTC | AGTTG | GCGGGAGGA | X | | | |
| 3 | 1 | 2 | AGCAGAGTC | CAAAAG | GGGTGAGGC | X | | | |
| 3 | 1 | 2 | ATCAGCGTC | CAGAG | GAGTGAACA | X | | | |
| 3 | 1 | 2 | AGCAGAGTC | TCAGAG | GAGTGAAGC | X | | | |
| 3 | 1 | 2 | AACAGCGTC | CTGGGA | GAGTGTGCA | X | | | |
| 3 | 1 | 2 | TGCAGCGTC | TTCTT | TAGTGAGCA | X | | | |
| 3 | 1 | 2 | AGCAGCTTC | CAACAA | TAGTAAGGA | X | | | |
| 3 | 1 | 2 | AGCAGTGTC | CCCTAT | AAGTGAGAA | X | | | |
| 3 | 1 | 2 | AGCAGCATC | AATCT | GAGTGTGGG | X | | | |
| 3 | 1 | 2 | AGCAGTGTC | AACAT | CAGTGAGAA | X | | | |
| 3 | 1 | 2 | AGCAGCTTC | TCCCA | GGGTGAGGC | X | | | |
| 3 | 1 | 2 | AGCAGAGTC | AGGCA | GGGTGAGGC | X | | | |
| 3 | 1 | 2 | AGCAGGGTC | TGCAGG | GAGTGTGGT | X | | | |
| 3 | 1 | 2 | AGCTGCGTC | CTCTA | GAGGGAGGG | X | | | |
| 3 | 1 | 2 | AGCAGCGTA | CCTGG | GTGTGAGAA | X | | | |
| 3 | 1 | 2 | AGCAGCCTC | AGAAAT | AGGTGAGGA | X | | | |
| 3 | 1 | 2 | AGCAGCGTT | CCTCT | CAGTGATGA | X | | | |
| 3 | 1 | 2 | AGCAGCCTC | TGGAGG | GAGGGAGGG | X | | | |
| 3 | 1 | 2 | AGCAGTGTC | AGATGG | TGGTGAGGA | X | | | |
| 3 | 1 | 2 | AGCAGTGTC | TTGTTA | AAGTGAAGA | X | | | |
| 3 | 1 | 2 | AGCAGCATC | TGGGTA | GAGTGAAGG | X | | | |
| 3 | 1 | 2 | AGCAGCATC | CTCCT | GGGTAAGGA | X | | | |
| 3 | 1 | 2 | AGCAGGGTC | CCTCT | GAGTGGGGC | X | | | |
| 3 | 1 | 2 | ATCAGCGTC | TTTCTT | GAGTGATAA | X | | | |
| 3 | 1 | 2 | AGCAGCATC | CTCCT | GGGTAAGGA | X | | | |
| 3 | 1 | 2 | AGCAGCATC | CTCCT | GGGTAAGGA | X | | | |
| 3 | 1 | 2 | AGCAGCATC | CTCCT | GGGTAAGGA | X | | | |
| 3 | 1 | 2 | AGCAGCATC | CTCCT | GGGTAAGGA | X | | | |
| 3 | 1 | 2 | AGCAGTGTC | TTAGGG | GAATGAGGC | X | | | |
| 3 | 1 | 2 | AGCAGCTTC | CAGGCA | GAGGGAGAA | X | | | |
| 3 | 1 | 2 | AGCAGCGTG | CTGCGA | GAGTGTGAA | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 3 | 1 | 2 | AGTAGCGTC | CTTGG | GATTGAAGA | X | | | |
| 3 | 1 | 2 | AGCAGCTTC | CAGACT | GAGGGAGAA | X | | | |
| 3 | 1 | 2 | AGCAGCGTG | GAGGA | GAGAGAGGC | X | | | |
| 3 | 1 | 2 | ATCAGCGTC | ATCCA | GAAGGAGGA | X | | | |
| 3 | 1 | 2 | AGCAGCATC | AAAGAG | GAGAGAGGG | X | | | |
| 3 | 1 | 2 | AGCAGTGTC | TTCCAT | GAGTGGGTA | X | | | |
| 3 | 1 | 2 | AGCAGCGAC | TGTAG | AAATGAGGA | X | | | |
| 3 | 1 | 2 | AGCAGTGTC | GATACA | TGGTGAGGA | X | | | |
| 3 | 1 | 2 | AGCAGCGTG | GAGAG | GAGGAAGGA | X | | | |
| 3 | 1 | 2 | AGCAGCTTC | ACTGT | GACTGAAGA | X | | | |
| 3 | 1 | 2 | AGCAGAGTC | CTCTT | TTGTGAGGA | X | | | |
| 3 | 1 | 2 | AGCAGCTTC | TCCAG | CAGTGATGA | X | | | |
| 3 | 1 | 2 | AGCAGTGTC | ATACT | AAGGGAGGA | X | | | |
| 3 | 1 | 2 | AGCCGCGTC | TCCAA | GAGTCAGTA | X | | | |
| 3 | 1 | 2 | TGCAGCGTC | AAATTG | GAGTAAGGG | X | | | |
| 3 | 1 | 2 | AGCAGCATC | AGAGGT | GTGTGAGAA | X | | | |
| 3 | 1 | 2 | AGCAGCGTG | TTCATG | GAGTGCGGC | X | | | |
| 3 | 1 | 2 | AGCAGTGTC | CTTTG | CAGTGAGAA | X | | | |
| 3 | 1 | 2 | AGCAGCGCC | TCTCA | GAGTGAACA | X | | | |
| 3 | 1 | 2 | AGCAGCATC | TTGGG | AACTGAGGA | X | | | |
| 3 | 1 | 2 | AGCAGCCTC | TTTTTG | GAGGGAGGG | X | | | |
| 3 | 1 | 2 | GGCAGCGTC | GCAGG | GAGTGGGAA | X | | | |
| 3 | 1 | 2 | AGCAGCCTC | GGAAAC | AAGTGAGGG | X | | | |
| 3 | 1 | 2 | AGCAGAGTC | TGATAT | GAGTGAGCT | X | | | |
| 3 | 1 | 2 | TGCAGCGTC | AGCAT | GAGTGGGGC | X | | | |
| 3 | 1 | 2 | AGCAGGGTC | TGGAGG | GAGACAGGA | X | | | |
| 3 | 1 | 2 | AGCAGAGTC | ACGAGA | GAATGGGGA | X | | | |
| 3 | 1 | 2 | AGCAGGGTC | CTGCA | GGGTGAGGC | X | | | |
| 3 | 1 | 2 | AGCAGCCTC | AGGGAT | GAGGGAGGT | X | | | |
| 3 | 1 | 2 | AGCAGCGGC | ATCGG | GGGCGAGGA | X | | | |
| 3 | 1 | 2 | AGCAGGGTC | ATCACA | GAGGGAAGA | X | | | |
| 3 | 1 | 2 | AGCAGTGTC | TGGTGT | GAGGGAGCA | X | | | |
| 3 | 1 | 2 | AGCAGCGGC | TGGGGG | GAGGCAGGA | X | | | |
| 3 | 1 | 2 | AGCAGCATC | CCTGGA | GAGGGAGAA | X | | | |
| 3 | 1 | 2 | AGCAGGGTC | GGTGTC | TGGTGAGGA | X | | | |
| 3 | 1 | 2 | AGCAGGGTC | CAGGT | AAGAGAGGA | X | | | |
| 3 | 1 | 2 | AGCAGTGTC | ATCTCT | GAGTGGAGA | X | | | |
| 3 | 1 | 2 | AGCAGCCTC | CGTCTA | GAGGGAGGT | X | | | |
| 3 | 1 | 2 | AGCAGCGCC | AGCCTC | AAGTGAGGG | X | | | |
| 3 | 1 | 2 | AGCAGCGAC | ATTGT | GAGTAAGCA | X | | | |
| 3 | 1 | 2 | AGCAGCTTC | CGGTG | TAGTGATGA | X | | | |
| 3 | 1 | 2 | AGCAGGGTC | CCAGCA | GAGAAAGGA | X | | | |
| 3 | 1 | 2 | AGCAGCGAC | TCCGG | GAGTGCAGA | X | | | |
| 3 | 1 | 2 | AGCAGCGTG | GGAAA | GAGGAAGGA | X | | | |
| 3 | 1 | 2 | GGCAGCGTC | TATGGA | GAATGAGAA | X | | | |
| 3 | 1 | 2 | AGCAGCCTC | CACACT | GAGGGAGGT | X | | | |
| 3 | 1 | 2 | AGCAGCCTC | CCTCTT | GTGTGAGGG | X | | | |
| 3 | 1 | 2 | TGCAGCGTC | GCTGA | AAGTGAGAA | X | | | |
| 3 | 1 | 2 | AGCAGTGTC | TTGTAT | GACTGAGGT | X | | | |
| 3 | 1 | 2 | AGCAACGTC | AGCAAA | GTGTCAGGA | X | | | |
| 3 | 1 | 2 | AGCAGCATC | AGCAG | GAGTGTGAA | X | | | |
| 3 | 1 | 2 | AGCAGCCTC | ATTGG | GAGTGAGTG | X | | | |
| 3 | 1 | 2 | AGCAGGGTC | TTGGAT | GAGTTAAGA | X | | | |
| 3 | 1 | 2 | AGCAGCGGC | AGACT | GAGCGAGCA | X | | | |
| 3 | 1 | 2 | AGCAGGGTC | CTGTTG | GAGACAGGA | X | | | |
| 3 | 1 | 2 | AGCAGCATC | AGCAT | CAGTTAGGA | X | | | |
| 3 | 1 | 2 | AGCAGAGTC | AGAAAT | GAGTGAAGC | X | | | |
| 3 | 1 | 2 | AGCAGCGCC | CACCCT | TGGTGAGGA | X | | | |
| 3 | 1 | 2 | AGCAGCGGC | TGATG | GAGGCAGGA | X | | | |
| 3 | 1 | 2 | AGCAGCCTC | GCTTTG | AGGTGAGGA | X | | | |
| 3 | 1 | 2 | AGCATCGTC | ATCCTA | GAGTCAGCA | X | | | |
| 3 | 1 | 2 | GGCAGCGTC | GGGCA | GAGGGAGAA | X | | | |
| 3 | 1 | 2 | AGCAGCCTC | ATCCT | GTGAGAGGA | X | | | |
| 3 | 1 | 2 | AGCAGTGTC | TTCCAT | GAGTGGGTA | X | | | |
| 3 | 1 | 2 | GGCAGCGTC | CAATCT | CAGTGAGAA | X | | | |
| 3 | 1 | 2 | AGCAGTGTC | ACCTCT | GAGTGGGTA | X | | | |
| 3 | 1 | 2 | AGCAGCATC | TATAGC | GACTGAGGT | X | | | |
| 3 | 1 | 2 | AGCAGTGTC | TGGTTT | GGGGGAGGA | X | | | |
| 3 | 1 | 2 | AGCAGAGTC | GGAGT | GAGAGAGGG | X | | | |
| 3 | 1 | 2 | AGTAGCGTC | TAGGC | AAGTGAGCA | X | | | |
| 3 | 1 | 2 | AGCAGCCTC | TACAT | GAGTGAGAC | X | | | |
| 3 | 1 | 2 | AGCAGTGTC | AATAA | GAGAGTGGA | X | | | |

| # of mutations T | (−) | (+) | (−) site | spacer | (+) site | 4 nM | 2 nM | 1 nM | 0.5 nM |
|---|---|---|---|---|---|---|---|---|---|
| 3 | 1 | 2 | AGCAGCGTT | TCTCA | AAGTGCGGA | X | | | |
| 3 | 1 | 2 | AGCAGCGAC | TGTGA | AAGTGAGAA | X | | | |
| 3 | 1 | 2 | AGCAGAGTC | CCTGT | GAGTGAAGG | X | | | |
| 3 | 1 | 2 | GGCAGCGTC | CTTTC | CAGCGAGGA | X | | | |
| 3 | 1 | 2 | AGCAGGGTC | AATGTC | TGGTGAGGA | X | | | |
| 3 | 1 | 2 | AGCAGCATC | AGGCT | GAGTGTGGT | X | | | |
| 3 | 1 | 2 | AGCAGTGTC | TCGTT | AGGTGAGGA | X | | | |
| 3 | 1 | 2 | AGCAGGGTC | AGCAAA | GAATGAGGC | X | | | |
| 3 | 1 | 2 | AGCAGAGTC | ACAAA | GAATGAGTA | X | | | |
| 3 | 1 | 2 | AGCAGCGTG | GGCTG | GAGGGAGAA | X | | | |
| 3 | 1 | 2 | AGCAGCGTG | TTCATG | GAGTGCGGC | X | | | |
| 3 | 1 | 2 | AGCAGCATC | TAACAG | GAGGGAGGG | X | | | |
| 3 | 1 | 2 | AGCAGCCTC | CTAGG | GAGGGAGGG | X | | | |
| 3 | 1 | 2 | AGCAGCTTC | TGAGC | TAGTGAAGA | X | | | |
| 3 | 1 | 2 | ATCAGCGTC | TACTAA | GAGAGTGGA | X | | | |
| 3 | 1 | 2 | AGCAGCATC | ACCTGC | GAGGGAGGG | X | | | |
| 3 | 1 | 2 | AGCAGCATC | GAGTT | GGGTGAGGT | X | | | |
| 3 | 1 | 2 | TGCAGCGTC | CAAGCT | CAGTGAGGC | X | | | |
| 3 | 1 | 2 | AGCAGCTTC | ATTTT | GAATGAGGG | X | | | |
| 3 | 1 | 2 | AGCAGCCTC | TTTTGG | GAGTGGGGG | X | | | |
| 3 | 1 | 2 | AGCAGCGCC | TCCCA | GAGTGGGGC | X | | | |
| 3 | 1 | 2 | AGCAGGGTC | CCCCA | GAGAAAGGA | X | | | |
| 3 | 1 | 2 | AGCAGCCTC | CCGGA | GAGGGAGGG | X | | | |
| 3 | 1 | 2 | GGCAGCGTC | GGGTGG | GAGAGAGAA | X | | | |
| 3 | 1 | 2 | AGCAGAGTC | TACCTT | GAGTGAAAA | X | | | |
| 3 | 1 | 2 | AGCAGCGAC | CCAAG | GAGTAAGAA | X | | | |
| 3 | 1 | 2 | AGCAGTGTC | TTTAGA | AAGTGAGCA | X | | | |
| 3 | 1 | 2 | AGCAGGGTC | GGGCC | TGGTGAGGA | X | | | |
| 3 | 1 | 2 | AGCAGCGGC | TGAATC | CTGTGAGGA | X | | | |
| 3 | 1 | 2 | TGCAGCGTC | TGGCAT | GAGTGGGGC | X | | | |
| 3 | 1 | 2 | AGAAGCGTC | ATGCT | GAGTGAAAA | X | | | |
| 3 | 1 | 2 | AGCAGGGTC | CAGGGA | GAGGGAAGA | X | | | |
| 3 | 1 | 2 | AGCAGCATC | CCTGT | GAGTGAGTG | X | | | |
| 3 | 1 | 2 | AGTAGCGTC | AATGAT | AAGTGTGGA | X | | | |
| 3 | 1 | 2 | AGCAGGGTC | CAGGT | AAGAGAGGA | X | | | |
| 3 | 1 | 2 | AGCAGGGTC | CAGGT | AAGAGAGGA | X | | | |
| 3 | 1 | 2 | AGCAGGGTC | CAGGT | AAGAGAGGA | X | | | |
| 3 | 2 | 1 | AGCAACCTC | ACCCCA | GAGAGAGGA | X | | | |
| 3 | 2 | 1 | AGCAACGTG | TGTTGG | GAGAGAGGA | X | | | |
| 3 | 2 | 1 | ATCAGGGTC | AGGTTT | TAGTGAGGA | X | | | |
| 3 | 2 | 1 | AGCAAAGTC | TGTAT | GAGTGAGCA | X | | | |
| 3 | 2 | 1 | AGCAGTGTA | AAGGAG | TAGTGAGGA | X | | | |
| 3 | 2 | 1 | AGCAGAGTA | AAGCAG | GTGTGAGGA | X | | | |
| 3 | 2 | 1 | AGCAGCCTG | GGAGA | GAGTGAGGG | X | | | |
| 3 | 2 | 1 | AGCAACCTC | CTGGGT | GAGAGAGGA | X | | | |
| 3 | 2 | 1 | AACAGCTTC | AGTACA | CAGTGAGGA | X | | | |
| 3 | 2 | 1 | AGTAGTGTC | AATGAA | GAGTGAAGA | X | | | |
| 3 | 2 | 1 | ATCAGGGTC | TAGGGA | GAGTGTGGA | X | | | |
| 3 | 2 | 1 | GGCAGGGTC | CCCGG | GAGGGAGGA | X | | | |
| 3 | 2 | 1 | AGCTGGGTC | TGAAGG | GTGTGAGGA | X | | | |
| 3 | 2 | 1 | AGCTGGGTC | CTCAG | GAGAGAGGA | X | | | |
| 3 | 2 | 1 | AGCAGCTCC | AGGGCC | GAGTGAGAA | X | | | |
| 3 | 2 | 1 | AGCAACATC | CGCTCT | GAGTGGGGA | X | | | |
| 3 | 2 | 1 | AACAGCTTC | ACAGG | CAGTGAGGA | X | | | |
| 3 | 2 | 1 | AGCAGCGCC | CAACAC | CAGTGAGGA | X | | | |
| 3 | 2 | 1 | AGCAGGGGC | AGTGG | GAGTGAGTA | X | | | |
| 3 | 2 | 1 | AGCATGGTC | TGGTT | GGGTGAGGA | X | | | |
| 3 | 2 | 1 | GGCAGCGTG | CTCTGA | GAGAGAGGA | X | | | |
| 3 | 2 | 1 | AGCAGAGCC | CCCTG | GAGTGAGGG | X | | | |
| 3 | 2 | 1 | AGCACCGTG | CTTCAA | AAGTGAGGA | X | | | |
| 3 | 2 | 1 | CCCAGCGTC | AGCAG | GAGTCAGGA | X | | | |
| 3 | 2 | 1 | AGGAGCGTG | GACACA | GAGTGAGGT | X | | | |
| 3 | 2 | 1 | AGCCGAGTC | TGTCCC | GAGTGTGGA | X | | | |
| 3 | 2 | 1 | AGTAGAGTC | TCTGTT | GAGTGAGTA | X | | | |
| 3 | 2 | 1 | ACCAGGGTC | ATGGC | AAGTGAGGA | X | | | |
| 3 | 2 | 1 | TGCAGGGTC | AGATTG | AAGTGAGGA | X | | | |
| 3 | 2 | 1 | AGCAGCGGG | GAGAGA | GAGCGAGGA | X | | | |
| 3 | 2 | 1 | TGCAGCGCC | GAGGT | GAGTGAGGG | X | | | |
| 3 | 2 | 1 | AGTAGAGTC | TGGCT | GAGGGAGGA | X | | | |
| 3 | 2 | 1 | TGCAGCGCC | GAGGT | GAGTGAGGG | X | | | |
| 3 | 2 | 1 | AGTAGGGTC | ACACTA | GAGTGAAGA | X | | | |
| 3 | 2 | 1 | TGCAGCGCC | GAGGT | GAGTGAGGG | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 3 | 2 | 1 | TGCAGCGCC | GAGGT | GAGTGAGGG | X | | | |
| 3 | 2 | 1 | TGCAGCGCC | GAGGT | GAGTGAGGG | X | | | |
| 3 | 2 | 1 | TGCAGCGCC | GAGGT | GAGTGAGGG | X | | | |
| 3 | 2 | 1 | TGCAGCGCC | GAGGT | GAGTGAGGG | X | | | |
| 3 | 2 | 1 | TGCAGCGCC | GAGGT | GAGTGAGGG | X | | | |
| 3 | 2 | 1 | AGCAGGGTA | AAGCAA | GAGTGAGAA | X | | | |
| 3 | 2 | 1 | AGCAGCGGG | GACCGG | GAGCGAGGA | X | | | |
| 3 | 2 | 1 | AGCAGGTTC | AGTGTC | TAGTGAGGA | X | | | |
| 3 | 2 | 1 | GGCATCGTC | TGCAGT | AAGTGAGGA | X | | | |
| 3 | 2 | 1 | AATAGCGTC | AGCCCC | AAGTGAGGA | X | | | |
| 3 | 2 | 1 | AGCAGCATG | GTATG | GAGGGAGGA | X | | | |
| 3 | 2 | 1 | AGCAGCCTG | CTGCA | GAGTGAGGG | X | | | |
| 3 | 2 | 1 | GGCAGCGTG | GTGGT | GAGAGAGGA | X | | | |
| 3 | 2 | 1 | AGCAGAGTT | GGTGTC | TAGTGAGGA | X | | | |
| 3 | 2 | 1 | AACAGAGTC | GGGAA | GAGTAAGGA | X | | | |
| 3 | 2 | 1 | AACAGCGGC | GTCCT | GAGTGTGGA | X | | | |
| 3 | 2 | 1 | AGCAGGGTG | TGAGA | GAGGGAGGA | X | | | |
| 3 | 2 | 1 | AGCTGCATC | AAACT | TAGTGAGGA | X | | | |
| 3 | 2 | 1 | GGCAGGGTC | TCCCG | GAGGGAGGA | X | | | |
| 3 | 2 | 1 | AGCAGCTTT | TCAGA | GAGTGAAGA | X | | | |
| 3 | 2 | 1 | AGCAGGGCC | CTGCT | GAGTGAGGG | X | | | |
| 3 | 2 | 1 | AGCAGGGCC | CTGCT | GAGTGAGGG | X | | | |
| 3 | 2 | 1 | GGCAGCGTT | GGGAT | GTGTGAGGA | X | | | |
| 3 | 2 | 1 | AACAGAGTC | ACAGT | GAGTAAGGA | X | | | |
| 3 | 2 | 1 | AGCAGGGCC | GGGCA | GAGTGAGGG | X | | | |
| 3 | 2 | 1 | GGGAGCGTC | TGCCC | CAGTGAGGA | X | | | |
| 3 | 2 | 1 | ATCAGTGTC | TAAAAT | GGGTGAGGA | X | | | |
| 3 | 2 | 1 | AGCGGCTTC | TGCCT | GAGTGAGGG | X | | | |
| 3 | 2 | 1 | AGCAATGTC | TGCCTT | GGGTGAGGG | X | | | |
| 3 | 2 | 1 | AGCAAAGTC | ACCAG | GAGTGAGCA | X | | | |
| 3 | 2 | 1 | AGCAATGTC | AATCAG | GAGAGAGGA | X | | | |
| 3 | 2 | 1 | AGCAGGGTG | GAAAG | GAATGAGGA | X | | | |
| 3 | 2 | 1 | ACCAGCCTC | CTGAGG | GAGTGAGGG | X | | | |
| 3 | 2 | 1 | AGAAGCGGC | GTTGT | AAGTGAGGA | X | | | |
| 3 | 2 | 1 | AGCAGTGTG | GTAGA | CAGTGAGGA | X | | | |
| 3 | 2 | 1 | AGCAATGTC | AGTCT | GAGTTAGGA | X | | | |
| 3 | 2 | 1 | AGCAGGGTG | TTGGAG | GAATGAGGA | X | | | |
| 3 | 2 | 1 | AGCAGCATG | GAAAA | GAGGGAGGA | X | | | |
| 3 | 2 | 1 | AGCAGCTTT | GTAGA | GAGTGAAGA | X | | | |
| 3 | 2 | 1 | AGCAAGGTC | TGGGA | GAGTCAGGA | X | | | |
| 3 | 2 | 1 | AGCAGCCTG | CCAAG | GAGTGAGGG | X | | | |
| 3 | 2 | 1 | AGCAGTGGC | TAAGA | GAGTGAGCA | X | | | |
| 3 | 2 | 1 | AACAGCGTG | TGTGA | AAGTGAGGA | X | | | |
| 3 | 2 | 1 | AGCATCCTC | TATGCT | GTGTGAGGA | X | | | |
| 3 | 2 | 1 | AGCAGAGCC | ATGAAG | GAGTGAGGC | X | | | |
| 3 | 2 | 1 | AGCAGCCGC | CTGAG | CAGTGAGGA | X | | | |
| 3 | 2 | 1 | AGCAGCGAG | GGAGG | AAGTGAGGA | X | | | |
| 3 | 2 | 1 | AGCCGGGTC | TTCCG | AAGTGAGGA | X | | | |
| 3 | 2 | 1 | AGCCTCGTC | CCCAGA | GAGGGAGGA | X | | | |
| 3 | 2 | 1 | AGGAGAGTC | CCATGA | GAGTGAGAA | X | | | |
| 3 | 2 | 1 | AGCAATGTC | AGATAG | GGGTGAGGA | X | | | |
| 3 | 2 | 1 | AGCATCGGC | CTCTCT | GAGTGACGA | X | | | |
| 3 | 2 | 1 | AGCATCTTC | AGTTG | AAGTGAGGA | X | | | |
| 3 | 2 | 1 | GGCAGCGTG | TATGAT | GAGAGAGGA | X | | | |
| 3 | 2 | 1 | AGCAGGGTA | AAGAGT | GAGTGAGAA | X | | | |
| 3 | 2 | 1 | AACAGAGTC | AGCCCT | TAGTGAGGA | X | | | |
| 3 | 2 | 1 | AGCACAGTC | CGGAT | GAGTGAGCA | X | | | |
| 3 | 2 | 1 | ATTAGCGTC | ACTTAG | AAGTGAGGA | X | | | |
| 3 | 2 | 1 | AACAGAGTC | AGAGA | TAGTGAGGA | X | | | |
| 3 | 2 | 1 | AGCAGCCTG | GCATG | GAGTGAGGG | X | | | |
| 3 | 2 | 1 | AACACCGTC | ACCTGT | GGGTGAGGA | X | | | |
| 3 | 2 | 1 | AGCAGCGGA | AATAA | GGGTGAGGA | X | | | |
| 3 | 2 | 1 | GGCAGCGTG | AACCCA | GAGTGAGTA | X | | | |
| 3 | 2 | 1 | AACACCGTC | CTGCCA | GTGTGAGGA | X | | | |
| 3 | 2 | 1 | AGCAGCGAT | GTTGT | AAGTGAGGA | X | | | |
| 3 | 2 | 1 | AGCAGGGTG | GGAAAG | GAGGGAGGA | X | | | |
| 3 | 2 | 1 | AGCTGGGTC | AGAGGT | GAGAGAGGA | X | | | |
| 3 | 2 | 1 | AGCAGCTCC | AGGGA | GAGTGAGAA | X | | | |
| 3 | 2 | 1 | AGCAATGTC | TTCCTT | GGGTGAGGA | X | | | |
| 3 | 2 | 1 | AGCACAGTC | TGAACA | GAGTGAGCA | X | | | |
| 3 | 2 | 1 | AGCAGCGGA | GGATCT | GGGTGAGGA | X | | | |
| 3 | 2 | 1 | AGCAGCTTT | TGGGA | GAGTGAGCA | X | | | |

-continued

| # of mutations | | | | | | VF2468 concentration | | | |
|---|---|---|---|---|---|---|---|---|---|
| T | (-) | (+) | (-) site | spacer | (+) site | 4 nM | 2 nM | 1 nM | 0.5 nM |
| 3 | 2 | 1 | AGCAGCGAT | TTGAAG | AAGTGAGGA | X | | | |
| 3 | 2 | 1 | AGCAGCAGC | ACAAA | GAGTGAGTA | X | | | |
| 3 | 2 | 1 | AGGAGCGGC | AGGTGA | TAGTGAGGA | X | | | |
| 3 | 2 | 1 | AGCACGGTC | CAAAG | GAGAGAGGA | X | | | |
| 3 | 2 | 1 | AGCTGGGTC | ATTCCC | CAGTGAGGA | X | | | |
| 3 | 2 | 1 | AGCTGAGTC | AGCCAA | GTGTGAGGA | X | | | |
| 3 | 2 | 1 | AGTAGGGTC | AACGTT | GAGTGAAGA | X | | | |
| 3 | 2 | 1 | AGTAGAGTC | AACAGT | GAGTGATGA | X | | | |
| 3 | 2 | 1 | AGGAGAGTC | GCTCT | GAGTGAGAA | X | | | |
| 3 | 2 | 1 | AGCGCCGTC | TCTGG | AAGTGAGGA | X | | | |
| 3 | 2 | 1 | AGCTGTGTC | CCTCCT | GAGGGAGGA | X | | | |
| 3 | 2 | 1 | AGCTGCCTC | CGTGGG | GAGTGAGGC | X | | | |
| 3 | 2 | 1 | AGCAGCCTG | CTGCA | GAGTGAGGG | X | | | |
| 3 | 2 | 1 | AGCAGCCTG | CTGCA | GAGTGAGGG | X | | | |
| 3 | 2 | 1 | GGCAGAGTC | GTGCA | TAGTGAGGA | X | | | |
| 3 | 2 | 1 | AGCATTGTC | AATATT | GAGGGAGGA | X | | | |
| 3 | 2 | 1 | AGCAGGGTG | GGTAA | GAGTGAGAA | X | | | |
| 3 | 2 | 1 | GGCAGGGTC | TCTGG | GAGGGAGGA | X | | | |
| 3 | 2 | 1 | AGTAGAGTC | CAGTA | GAGTGATGA | X | | | |
| 3 | 2 | 1 | AGCAGGGCC | CTGCT | GAGTGAGGG | X | | | |
| 3 | 2 | 1 | AGCAAAGTC | TTTAG | GAGAGAGGA | X | | | |
| 3 | 2 | 1 | AGCAGTGCC | CTGAA | GAGTGAGAA | X | | | |
| 3 | 2 | 1 | GGCAGGGTC | CGAGCC | CAGTGAGGA | X | | | |
| 3 | 2 | 1 | AGCTGGGTC | TGGCT | GAGTGTGGA | X | | | |
| 3 | 2 | 1 | AGCAGCTTT | CATGG | AAGTGAGGA | X | | | |
| 3 | 2 | 1 | ATCATCGTC | ATCGT | GAGAGAGGA | X | | | |
| 3 | 2 | 1 | AGCCGCGTG | AGGGC | AAGTGAGGA | X | | | |
| 3 | 2 | 1 | AGCAGGGTG | GGCAAG | GAGGGAGGA | X | | | |
| 3 | 2 | 1 | AGCATGGTC | AAGTTT | GGGTGAGGA | X | | | |
| 3 | 2 | 1 | ATCAGAGTC | AGAGA | AAGTGAGGA | X | | | |
| 3 | 2 | 1 | AGCAGTGGC | AGAAT | AAGTGAGGA | X | | | |
| 3 | 2 | 1 | AGGAGTGTC | TGCAA | AAGTGAGGA | X | | | |
| 3 | 2 | 1 | TGCAGGGTC | AAGCC | AAGTGAGGA | X | | | |
| 3 | 2 | 1 | AGCAGGTTC | AGTGTC | TAGTGAGGA | X | | | |
| 3 | 2 | 1 | AGCAGCGGA | AATAA | GGGTGAGGA | X | | | |
| 3 | 2 | 1 | AGCAGGGTG | CTCGG | GAGGGAGGA | X | | | |
| 3 | 2 | 1 | AGCAACCTC | CCCACA | GAGGGAGGA | X | | | |
| 3 | 2 | 1 | AGCAGGGTG | GGGGA | GAGGGAGGA | X | | | |
| 3 | 2 | 1 | AGCAACCTC | TGCTCA | GAGAGAGGA | X | | | |
| 3 | 2 | 1 | TGCAGGGTC | TGCGG | AAGTGAGGA | X | | | |
| 3 | 2 | 1 | AGCAGGTTC | AGACTG | AAGTGAGGA | X | | | |
| 3 | 2 | 1 | AGCAATGTC | ACCAT | GAGTGTGGA | X | | | |
| 3 | 2 | 1 | AGCACGGTC | CCCAAG | GAGGGAGGA | X | | | |
| 3 | 2 | 1 | AGCAGCGCT | CGGGC | GAGGGAGGA | X | | | |
| 3 | 2 | 1 | AGCAGGGAC | TGGTCA | GAGTGAGGT | X | | | |
| 3 | 2 | 1 | AGCAGCCAC | ACAATC | CAGTGAGGA | X | | | |
| 3 | 2 | 1 | AGTAGAGTC | AAGAGG | GAGTGAGTA | X | | | |
| 3 | 2 | 1 | AGCCTCGTC | TTGGT | GAGGGAGGA | X | | | |
| 3 | 2 | 1 | GGCAGCGGC | CTGGAG | GGGTGAGGA | X | | | |
| 3 | 2 | 1 | AGCAGAGTT | GGTTTC | TAGTGAGGA | X | | | |
| 3 | 2 | 1 | AGCATCTTC | ACCTG | AAGTGAGGA | X | | | |
| 3 | 2 | 1 | AGCAACATC | ATAAT | GAGTGGGGA | X | | | |
| 3 | 2 | 1 | AGCACAGTC | CCTAA | GAGTGAGCA | X | | | |
| 3 | 3 | 0 | AGGAGTTTC | CAGTT | GAGTGAGGA | X | | | |
| 3 | 3 | 0 | GGCAGCAGC | CATCA | GAGTGAGGA | X | | | |
| 3 | 3 | 0 | AGCAGGTTG | TTGGAG | GAGTGAGGA | X | | | |
| 3 | 3 | 0 | AACAGTGCC | CTGGT | GAGTGAGGA | X | | | |
| 3 | 3 | 0 | TGGAGCGTG | GGGGA | GAGTGAGGA | X | | | |
| 3 | 3 | 0 | TGGAGCGTG | GAAGAG | GAGTGAGGA | X | | | |
| 3 | 3 | 0 | AGCTGAGGC | ACAGG | GAGTGAGGA | X | | | |
| 3 | 3 | 0 | TGCAGGGTG | GACCCA | GAGTGAGGA | X | | | |
| 3 | 3 | 0 | AACAGAGTG | AGGCT | GAGTGAGGA | X | | | |
| 3 | 3 | 0 | AGCAACTTA | TTGCT | GAGTGAGGA | X | | | |
| 3 | 3 | 0 | AGCACAATC | TTTTTG | GAGTGAGGA | X | | | |
| 3 | 3 | 0 | TGGAGGGTC | GGTGGA | GAGTGAGGA | X | | | |
| 3 | 3 | 0 | AGCCGTGTG | GCTACG | GAGTGAGGA | X | | | |
| 3 | 3 | 0 | TGCTGCTTC | TGCCGT | GAGTGAGGA | X | | | |
| 3 | 3 | 0 | AACAGAGTA | ACACA | GAGTGAGGA | X | | | |
| 3 | 3 | 0 | ACCAACTTC | ATGTA | GAGTGAGGA | X | | | |
| 3 | 3 | 0 | AGGAGAGTG | AGTGT | GAGTGAGGA | X | | | |
| 3 | 3 | 0 | GGCAGGGTG | GCGAAG | GAGTGAGGA | X | | | |
| 3 | 3 | 0 | GGCAGGGTG | GCCGGG | GAGTGAGGA | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 3 | 3 | 0 | AGCAGGGCT | CCTGGT | GAGTGAGGA | X | | | |
| 3 | 3 | 0 | TACAGTGTC | AGCAGT | GAGTGAGGA | X | | | |
| 3 | 3 | 0 | ATCACCTTC | TTTCAT | GAGTGAGGA | X | | | |
| 3 | 3 | 0 | TTCAGTGTC | TGACGG | GAGTGAGGA | X | | | |
| 3 | 3 | 0 | AGCAGCTCA | GGTTAG | GAGTGAGGA | X | | | |
| 3 | 3 | 0 | AGGAGAGTA | GGGCT | GAGTGAGGA | X | | | |
| 3 | 3 | 0 | ACCTGGGTC | TGAGCA | GAGTGAGGA | X | | | |
| 3 | 3 | 0 | ATCAGTGTG | TTTTT | GAGTGAGGA | X | | | |
| 3 | 3 | 0 | TGGAGGGTC | AGAGGA | GAGTGAGGA | X | | | |
| 3 | 3 | 0 | GGCAGGGTG | CGAGG | GAGTGAGGA | X | | | |
| 3 | 3 | 0 | AGGAGAGTG | AATGT | GAGTGAGGA | X | | | |
| 3 | 3 | 0 | AGCAGTGCA | CCCAA | GAGTGAGGA | X | | | |
| 3 | 3 | 0 | AGCAGGTTG | AAGACT | GAGTGAGGA | X | | | |
| 3 | 3 | 0 | AGGAGAGTG | AGAAGT | GAGTGAGGA | X | | | |
| 3 | 3 | 0 | AGCAGCCGT | AACAAA | GAGTGAGGA | X | | | |
| 3 | 3 | 0 | AGCAGGGCA | GGGCA | GAGTGAGGA | X | | | |
| 3 | 3 | 0 | GCCAGCCTC | AGGCT | GAGTGAGGA | X | | | |
| 3 | 3 | 0 | AGCAGGGCT | TGGTGG | GAGTGAGGA | X | | | |
| 3 | 3 | 0 | AGTAGCAAC | TATTA | GAGTGAGGA | X | | | |
| 3 | 3 | 0 | AACAGCGGA | GATTT | GAGTGAGGA | X | | | |
| 3 | 3 | 0 | AGGACCATC | CGAGA | GAGTGAGGA | X | | | |
| 3 | 3 | 0 | AGGACCATC | CCAGG | GAGTGAGGA | X | | | |
| 3 | 3 | 0 | AGGACCATC | CCAGG | GAGTGAGGA | X | | | |
| 3 | 3 | 0 | AGCAGGTTA | ACAGG | GAGTGAGGA | X | | | |
| 3 | 3 | 0 | TGCAGGGTG | AGCCT | GAGTGAGGA | X | | | |
| 3 | 3 | 0 | AGAAGGGTA | GAAAG | GAGTGAGGA | X | | | |
| 3 | 3 | 0 | AGATGCGGC | CAGTA | GAGTGAGGA | X | | | |
| 3 | 3 | 0 | AATAGGGTC | AGGTAG | GAGTGAGGA | X | | | |
| 3 | 3 | 0 | AGCAGTGAA | GGTGG | GAGTGAGGA | X | | | |
| 3 | 3 | 0 | AGAAACGTG | GAAAA | GAGTGAGGA | X | | | |
| 3 | 3 | 0 | AACAGGGAC | CTTAT | GAGTGAGGA | X | | | |
| 3 | 3 | 0 | AGCAAGGAC | TTAAA | GAGTGAGGA | X | | | |
| 3 | 3 | 0 | AGCAGATGC | CCTTG | GAGTGAGGA | X | | | |
| 3 | 3 | 0 | AGCAGCTGT | GCATA | GAGTGAGGA | X | | | |
| 3 | 3 | 0 | AGAAGGGTT | TGTGCA | GAGTGAGGA | X | | | |
| 3 | 3 | 0 | AACAGAGTG | GTTTA | GAGTGAGGA | X | | | |
| 3 | 3 | 0 | GGCAGTGGC | AGTGG | GAGTGAGGA | X | | | |
| 3 | 3 | 0 | AGCACCGAG | CCCCT | GAGTGAGGA | X | | | |
| 3 | 3 | 0 | ATCAGCATG | AAATG | GAGTGAGGA | X | | | |
| 3 | 3 | 0 | AGCTGTGTG | ACCCT | GAGTGAGGA | X | | | |
| 3 | 3 | 0 | TGCAGGGTG | GGAATA | GAGTGAGGA | X | | | |
| 3 | 3 | 0 | TGCAGGGTG | TAGTG | GAGTGAGGA | X | | | |
| 3 | 3 | 0 | AGGAGGTTC | TGGGAG | GAGTGAGGA | X | | | |
| 3 | 3 | 0 | AGGAATGTC | CTGGTC | GAGTGAGGA | X | | | |
| 3 | 3 | 0 | AGTAGCTGC | CTTTGG | GAGTGAGGA | X | | | |
| 3 | 3 | 0 | AGAAGGGTG | GGAGGG | GAGTGAGGA | X | | | |
| 3 | 3 | 0 | AGTAGCTGC | CTTTGG | GAGTGAGGA | X | | | |
| 3 | 3 | 0 | AGTAGCTGC | CTTTGG | GAGTGAGGA | X | | | |
| 3 | 3 | 0 | AGTAGCTGC | CTTTGG | GAGTGAGGA | X | | | |
| 3 | 3 | 0 | AGTAGCTGC | CTTTGG | GAGTGAGGA | X | | | |
| 3 | 3 | 0 | AGTAGCTGC | CTTTGG | GAGTGAGGA | X | | | |
| 3 | 3 | 0 | AGTAGAGGC | TGGAG | GAGTGAGGA | X | | | |
| 3 | 3 | 0 | GGCAGCAGC | AATAGA | GAGTGAGGA | X | | | |
| 3 | 3 | 0 | AGCAGCACA | AGCACT | GAGTGAGGA | X | | | |
| 3 | 3 | 0 | TGCATCGTA | AGCAT | GAGTGAGGA | X | | | |
| 3 | 3 | 0 | GGCAGGGTG | GGGGT | GAGTGAGGA | X | | | |
| 3 | 3 | 0 | AGCAGCTGA | AAGAGG | GAGTGAGGA | X | | | |
| 3 | 3 | 0 | TGGAGCGTG | GGAGGA | GAGTGAGGA | X | | | |
| 3 | 3 | 0 | TCCAGGGTC | ACTAAT | GAGTGAGGA | X | | | |
| 3 | 3 | 0 | TGCAGCGAA | AGGCA | GAGTGAGGA | X | | | |
| 3 | 3 | 0 | AGCAGGTTG | GGGAA | GAGTGAGGA | X | | | |
| 3 | 3 | 0 | AGCTGAGGC | TGGCA | GAGTGAGGA | X | | | |
| 3 | 3 | 0 | AACAGTGGC | AAATGA | GAGTGAGGA | X | | | |
| 3 | 3 | 0 | GGCAGTGCC | TGAAGG | GAGTGAGGA | X | | | |
| 3 | 3 | 0 | GGCAGTGCC | TGAAGG | GAGTGAGGA | X | | | |
| 3 | 3 | 0 | GGCAGTGCC | TGAAGG | GAGTGAGGA | X | | | |
| 3 | 3 | 0 | AGGAGAGTA | TGGAG | GAGTGAGGA | X | | | |
| 3 | 3 | 0 | CGCAGCATT | GCACGG | GAGTGAGGA | X | | | |
| 3 | 3 | 0 | GGAAGTGTC | CTTCAA | GAGTGAGGA | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 3 | 3 | 0 | AGCTGCATA | AGGAAA | GAGTGAGGA | X | | | |
| 3 | 3 | 0 | ACTAGGGTC | TTTGGA | GAGTGAGGA | X | | | |
| 3 | 3 | 0 | AGCTGTGTG | CCAGG | GAGTGAGGA | X | | | |
| 3 | 3 | 0 | ACCACTGTC | AGCTGT | GAGTGAGGA | X | | | |
| 3 | 3 | 0 | GGTAGCTTC | TCCTG | GAGTGAGGA | X | | | |
| 3 | 3 | 0 | AGCAGGGCT | GGGCAG | GAGTGAGGA | X | | | |
| 3 | 3 | 0 | AGCTGTGTG | ATGGGA | GAGTGAGGA | X | | | |
| 3 | 3 | 0 | TGAAGAGTC | CAAGG | GAGTGAGGA | X | | | |
| 3 | 3 | 0 | TGAAGAGTC | CAAGG | GAGTGAGGA | X | | | |
| 3 | 3 | 0 | ACGAGGGTC | CATAG | GAGTGAGGA | X | | | |
| 3 | 3 | 0 | AGAAGCGGT | GGAGT | GAGTGAGGA | X | | | |
| 3 | 3 | 0 | GGCAGAGTT | GTACTG | GAGTGAGGA | X | | | |
| 3 | 3 | 0 | AGCAGTTAC | GGCAAA | GAGTGAGGA | X | | | |
| 3 | 3 | 0 | TGCAGTGTG | CAAGGA | GAGTGAGGA | X | | | |
| 3 | 3 | 0 | CTCTGCGTC | TGGAA | GAGTGAGGA | X | | | |
| 3 | 3 | 0 | AGGAGAGTG | AGAGAA | GAGTGAGGA | X | | | |
| 3 | 3 | 0 | AGGAGAGTG | AGAGAA | GAGTGAGGA | X | | | |
| 3 | 3 | 0 | AATAGGGTC | AGGTAG | GAGTGAGGA | X | | | |
| 4 | 0 | 4 | AGCAGCGTC | TCCGAA | GACTCATGT | X | | | |
| 4 | 0 | 4 | AGCAGCGTC | ACATAA | TAGTGGAGC | X | | | |
| 4 | 0 | 4 | AGCAGCGTC | CAGGA | GTGGGAGTC | X | | | |
| 4 | 0 | 4 | AGCAGCGTC | TGGTCT | GGCGGAGGC | X | | | |
| 4 | 0 | 4 | AGCAGCGTC | TTAGA | AGGTGACAA | X | | | |
| 4 | 0 | 4 | AGCAGCGTC | AGAGGA | GGGAGACCA | X | | | |
| 4 | 0 | 4 | AGCAGCGTC | ACTGGT | AAGACATGA | X | | | |
| 4 | 0 | 4 | AGCAGCGTC | CCTGG | CATGGAGCA | X | | | |
| 4 | 0 | 4 | AGCAGCGTC | TGACAG | CAGTGAAAC | X | | | |
| 4 | 0 | 4 | AGCAGCGTC | TCCAGG | GTGTGCTGC | X | | | |
| 4 | 0 | 4 | AGCAGCGTC | TCAGA | GGTAGAGCA | X | | | |
| 4 | 0 | 4 | AGCAGCGTC | GAGACC | CATGGAGCA | X | | | |
| 4 | 0 | 4 | AGCAGCGTC | GTGGC | AGGGCAGGA | X | | | |
| 4 | 0 | 4 | AGCAGCGTC | CTGGG | GAGCGCGTC | X | | | |
| 4 | 0 | 4 | AGCAGCGTC | GTTCGG | GGCTGAGAT | X | | | |
| 4 | 0 | 4 | AGCAGCGTC | AGGCT | GTGGGAGCC | X | | | |
| 4 | 0 | 4 | AGCAGCGTC | CACTG | TGGTAAGCA | X | | | |
| 4 | 0 | 4 | AGCAGCGTC | TGCATG | GTGTGTTGC | X | | | |
| 4 | 0 | 4 | AGCAGCGTC | TAATAC | AATTGAGTT | X | | | |
| 4 | 0 | 4 | AGCAGCGTC | AACTGT | GTGAGTTGA | X | | | |
| 4 | 0 | 4 | AGCAGCGTC | AAGTCT | GTGTGCTGC | X | | | |
| 4 | 0 | 4 | AGCAGCGTC | TACAGT | GACTGCCGT | X | | | |
| 4 | 0 | 4 | AGCAGCGTC | TGTGC | CATGGAGCA | X | | | |
| 4 | 0 | 4 | AGCAGCGTC | TCCTT | GAGCGGTGC | X | | | |
| 4 | 0 | 4 | AGCAGCGTC | TCCTTG | GGCAGAGGT | X | | | |
| 4 | 0 | 4 | AGCAGCGTC | ACGTG | CCGCTAGGA | X | | | |
| 4 | 1 | 3 | AGCCGCGTC | GCGGA | GAGGGCGGC | X | | | |
| 4 | 1 | 3 | AGCAGTGTC | CTGAGG | GTGTGAAGG | X | | | |
| 4 | 1 | 3 | AGCAGTGTC | AGATT | AAGTGAGCC | X | | | |
| 4 | 1 | 3 | AGCATCGTC | AATTA | CAGTGAAAA | X | | | |
| 4 | 1 | 3 | AGCAGCGGC | TGTGG | CAGTGTGGT | X | | | |
| 4 | 1 | 3 | AGCAACGTC | GTGACA | GAGCCTGGA | X | | | |
| 4 | 1 | 3 | AGCAGTGTC | ACAGT | GTGTGAGAG | X | | | |
| 4 | 1 | 3 | AGCAGCGGC | TCCCAG | GAGAGGGGC | X | | | |
| 4 | 1 | 3 | AGCAACGTC | AGCAAA | GTCTCAGGA | X | | | |
| 4 | 1 | 3 | AGCAACGTC | AGCAAA | GTCTCAGGA | X | | | |
| 4 | 1 | 3 | AGTAGCGTC | TCGCT | GTGTGAGTG | X | | | |
| 4 | 1 | 3 | AGCAACGTC | AGCAGA | GTCTCAGGA | X | | | |
| 4 | 1 | 3 | AGCAGCGTT | ATTCT | GAGTGATAT | X | | | |
| 4 | 1 | 3 | AGCAGTGTC | CAGTA | GTGTAAGGT | X | | | |
| 4 | 1 | 3 | AGCAACGTC | AGCAAA | GTCTCAGGA | X | | | |
| 4 | 1 | 3 | AGCAACGTC | AGCAAA | GTCTCAGGA | X | | | |
| 4 | 1 | 3 | GGCAGCGTC | GGGATA | TGGTGAGGG | X | | | |
| 4 | 1 | 3 | AGCAACGTC | AGCAAA | GTCTCAGGA | X | | | |
| 4 | 1 | 3 | AGCAGAGTC | GCTCA | CTGTGAGGC | X | | | |
| 4 | 1 | 3 | AGCAGCGGC | AGCGGC | GAGGGCGGC | X | | | |
| 4 | 1 | 3 | AGCAGTGTC | AGAGCA | GAGAGAGCC | X | | | |
| 4 | 1 | 3 | AGCATCGTC | TGATCC | TTGTGAGGG | X | | | |
| 4 | 1 | 3 | AGCAACGTC | AGCAAA | GTCTCAGGA | X | | | |
| 4 | 1 | 3 | AGCAACGTC | AGCAAA | GTCTCAGGA | X | | | |
| 4 | 1 | 3 | AGCAGGGTC | TCCTG | TAGTGAGTC | X | | | |
| 4 | 1 | 3 | ACCAGCGTC | TGCTTC | TGGTGAGGC | X | | | |
| 4 | 1 | 3 | AGCAACGTC | AGCAAA | GTCTCAGGA | X | | | |
| 4 | 1 | 3 | AGCAGCATC | AGCTG | GAGGAAGGG | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 4 | 1 | 3 | AGCAGCGGC | AACGAT | GAGCAAGAA | X | | | |
| 4 | 1 | 3 | AGCAGTGTC | AGCAGC | AAGTGTGGT | X | | | |
| 4 | 1 | 3 | AGCAACGTC | AGCAAA | GTCTCAGGA | X | | | |
| 4 | 1 | 3 | AGCAGCGGC | CACAGA | GGTTGAGGC | X | | | |
| 4 | 1 | 3 | AGCAGCGGC | ACCTG | GGGAGAGGC | X | | | |
| 4 | 1 | 3 | AGCAGTGTC | AGTGGT | GGAGGAGGA | X | | | |
| 4 | 1 | 3 | AGCAACGTC | AGCAAA | GTCTCAGGA | X | | | |
| 4 | 1 | 3 | AGCAGAGTC | CTGGGA | GACTGAACA | X | | | |
| 4 | 1 | 3 | AGCAGTGTC | AGATA | GAGGGAGCC | X | | | |
| 4 | 1 | 3 | AGCAGTGTC | CATTTG | AAGGGAGGT | X | | | |
| 4 | 1 | 3 | TGCAGCGTC | TGTGT | GAGTGTCGT | X | | | |
| 4 | 1 | 3 | GGCAGCGTC | TGTCT | GTGTGAGCT | X | | | |
| 4 | 1 | 3 | AGCAGCGTG | TTTTAA | GAGTGAAAG | X | | | |
| 4 | 1 | 3 | AGCAGCGGC | TGTGAA | AGGTGAGGT | X | | | |
| 4 | 1 | 3 | AGCAGTGTC | CAGGA | GGAGGAGGA | X | | | |
| 4 | 1 | 3 | AGCAGTGTC | TTGCAT | GTGGGAGGT | X | | | |
| 4 | 1 | 3 | ACCAGCGTC | TGCTTC | TGGTGAGGC | X | | | |
| 4 | 1 | 3 | AGCAACGTC | CATCCT | GAGAGATGG | X | | | |
| 4 | 1 | 3 | AGCAACGTC | AGCAAA | GTCTCAGGA | X | | | |
| 4 | 1 | 3 | AGCAACGTC | ACAGGT | GAGTTGAGA | X | | | |
| 4 | 1 | 3 | AGCAACGTC | CAGAA | AATTGAGCA | X | | | |
| 4 | 1 | 3 | AGCAGTGTC | TTTTT | GAGTAGGCA | X | | | |
| 4 | 1 | 3 | AGCAGCGGC | AGCAT | TAGGGAGGT | X | | | |
| 4 | 1 | 3 | AGCAGTGTC | CTCATG | GGAGGAGGA | X | | | |
| 4 | 1 | 3 | AGCAGCGGC | CAAGA | GAGTGAATT | X | | | |
| 4 | 1 | 3 | AGCAACGTC | AGCAAA | GTCTCAGGA | X | | | |
| 4 | 1 | 3 | AGCAGAGTC | AGGGA | GACTGAGTC | X | | | |
| 4 | 1 | 3 | AGCAGTGTC | CAGCGT | GAGGGAGAT | X | | | |
| 4 | 1 | 3 | AGCACCGTC | TGGGA | GTATGAGGC | X | | | |
| 4 | 1 | 3 | ACCAGCGTC | CACTTC | TGGTGAGGC | X | | | |
| 4 | 1 | 3 | AGCAACGTC | AGCAAA | GTCTCAGGA | X | | | |
| 4 | 1 | 3 | AGCAACGTC | AGCAAA | GTCTCAGGA | X | | | |
| 4 | 1 | 3 | AGCAACGTC | AGAAAA | GTCTCAGGA | X | | | |
| 4 | 1 | 3 | AGCAGGGTC | CAAAA | GAGTGATTT | X | | | |
| 4 | 1 | 3 | AGCAGTGTC | AGCCCA | GAGTGAATT | X | | | |
| 4 | 1 | 3 | AGCAACGTC | AGCAAA | GTCTCAGGA | X | | | |
| 4 | 1 | 3 | AGCAACGTC | AGCAAA | GTCTCAGGA | X | | | |
| 4 | 1 | 3 | AGCAGTGTC | AACTAG | GAGTAGGCA | X | | | |
| 4 | 1 | 3 | AGCAGCGGC | ATTAC | GAGTAAGCT | X | | | |
| 4 | 1 | 3 | AGCAACGTC | AGCAAA | GTCTCAGGA | X | | | |
| 4 | 1 | 3 | AGCAACGTC | AACAAA | GTCTCAGGA | X | | | |
| 4 | 1 | 3 | AGCAGCTTC | CTCTG | GGGAGTGGA | X | | | |
| 4 | 1 | 3 | AGCAGTGTC | TCCCC | GAGGGAAAA | X | | | |
| 4 | 1 | 3 | AGCATCGTC | CGGGG | AGGTGAGAA | X | | | |
| 4 | 1 | 3 | AGCAGCGGC | TCTCA | AAGTGTGGT | X | | | |
| 4 | 1 | 3 | AGCATCGTC | CGGGG | AGGTGAGAA | X | | | |
| 4 | 1 | 3 | AGCAGCGTT | CACACT | CAGAGAGGT | X | | | |
| 4 | 1 | 3 | AGCAGCGGC | CGGAGC | AAGAGAGGG | X | | | |
| 4 | 1 | 3 | AACAGCGTC | AATGT | GTGTGAGAG | X | | | |
| 4 | 1 | 3 | AGCATCGTC | CGGGG | AGGTGAGAA | X | | | |
| 4 | 1 | 3 | AGCATCGTC | CGGGG | AGGTGAGAA | X | | | |
| 4 | 1 | 3 | AGCATCGTC | TGGGG | AGGTGAGAA | X | | | |
| 4 | 1 | 3 | AGCATCGTC | CGGGG | AGGTGAGAA | X | | | |
| 4 | 1 | 3 | AGCAGCATC | AGCGA | GAGGAAGGG | X | | | |
| 4 | 1 | 3 | AGCAACGTC | AGCAAA | GTCTCAGGA | X | | | |
| 4 | 1 | 3 | AGCACCGTC | CAGTGT | GGGTGAAGC | X | | | |
| 4 | 1 | 3 | AGCAACGTC | AGCAAA | GTCTCAGGA | X | | | |
| 4 | 1 | 3 | AACAGCGTC | AACGT | GAGTGAATT | X | | | |
| 4 | 1 | 3 | AGCAACGTC | AGCAAA | GTCTCAGGA | X | | | |
| 4 | 1 | 3 | AGCAACGTC | AGCAAA | GTCTCAGGA | X | | | |
| 4 | 1 | 3 | AGCACCGTC | TCCTGA | GGGTGAGTG | X | | | |
| 4 | 1 | 3 | AGCACCGTC | CTTTCC | GTGTGGGGT | X | | | |
| 4 | 1 | 3 | AGCAGGGTC | AAAAAG | TAGTGTTGA | X | | | |
| 4 | 1 | 3 | AGCAACGTC | CCTCAT | GAATAAAGA | X | | | |
| 4 | 1 | 3 | AGCAACGTC | AGCAAA | GTCTCAGGA | X | | | |
| 4 | 1 | 3 | AGCAGCTTC | TCTGA | GGGAGTGGA | X | | | |
| 4 | 1 | 3 | GGCAGCGTC | TGGGAT | GAGGAAGGC | X | | | |
| 4 | 1 | 3 | AGCAACGTC | AGCAAA | GTCTCAGGA | X | | | |
| 4 | 1 | 3 | AGCAGCGGC | AACTT | AAGAGTGGA | X | | | |
| 4 | 1 | 3 | AGCAGCGGC | CTCAG | AAGTGAGCC | X | | | |
| 4 | 1 | 3 | AGCAGTGTC | TGCACA | GAGTAGGCA | X | | | |
| 4 | 1 | 3 | AGCAGTGTC | CCGAGG | CTGTGAGGC | X | | | |

| # of mutations | | | (-) site | spacer | (+) site | VF2468 concentration | | | |
|---|---|---|---|---|---|---|---|---|---|
| T | (-) | (+) | | | | 4 nM | 2 nM | 1 nM | 0.5 nM |
| 4 | 1 | 3 | AGCAACGTC | AGCAAA | GTCTCAGGA | X | | | |
| 4 | 1 | 3 | AGCAACGTC | AGCAAA | GTCTCAGGA | X | | | |
| 4 | 1 | 3 | AGCAGTGTC | CAGCA | CAGTGAGAT | X | | | |
| 4 | 1 | 3 | AGCAACGTC | CAGAGG | GAGGAAAGA | X | | | |
| 4 | 1 | 3 | AGCAGCGTG | TTAATT | AAGTGAGTC | X | | | |
| 4 | 1 | 3 | AGCAGGGTC | TAAGG | GAGTGATTT | X | | | |
| 4 | 1 | 3 | AGCACCGTC | TGGGA | GTTTCAGGA | X | | | |
| 4 | 1 | 3 | AGCACCGTC | TGGGA | GTTTCAGGA | X | | | |
| 4 | 1 | 3 | ATCAGCGTC | CAGCGT | GAGGTAGGC | X | | | |
| 4 | 1 | 3 | AGCATCGTC | AATTA | TAGTGAGAC | X | | | |
| 4 | 1 | 3 | AGCAACGTC | AGCAAA | GTCTCAGGA | X | | | |
| 4 | 1 | 3 | AGCAGCGAC | ATCCT | GAGTGGGCT | X | | | |
| 4 | 1 | 3 | AGCACCGTC | CAGACA | GAGCAGGGA | X | | | |
| 4 | 1 | 3 | AGCAGTGTC | ATTTTC | TGGTGAGGG | X | | | |
| 4 | 1 | 3 | AGCAGTGTC | CTGTG | GAGTGTTGG | X | | | |
| 4 | 1 | 3 | AGCAGCGGC | GAGGT | TAGTGTGGT | X | | | |
| 4 | 1 | 3 | AGCAGGGTC | CACAGT | GTGTGAGAT | X | | | |
| 4 | 2 | 2 | AGCACCGGC | CGGCC | GAGGGAGGG | X | | | |
| 4 | 2 | 2 | AGCAGAGTG | CCAGG | GAGTGAGAT | X | | | |
| 4 | 2 | 2 | AGCAAGGTC | TGCATT | GAGAGAGGC | X | | | |
| 4 | 2 | 2 | AGCATGGTC | CAGCA | GAGTGAGCC | X | | | |
| 4 | 2 | 2 | ATCAGTGTC | ATCCTG | GAGTAAGGT | X | | | |
| 4 | 2 | 2 | AGCATGGTC | GTGGA | AAGTGAGTA | X | | | |
| 4 | 2 | 2 | AGCAATGTC | TGTGG | GAGGGAGGC | X | | | |
| 4 | 2 | 2 | AGCATTGTC | TGCAGT | GAGTGTGGG | X | | | |
| 4 | 2 | 2 | AGCATTGTC | TCCCTC | CAGTGAGGG | X | | | |
| 4 | 2 | 2 | AGCAAGGTC | AGTGTC | TAGTGAGGG | X | | | |
| 4 | 2 | 2 | AGCAGGGTA | GTGGT | GAGTAAGGT | X | | | |
| 4 | 2 | 2 | AGCAGCGCA | GGCCG | GGGTGAGGG | X | | | |
| 4 | 2 | 2 | AGCAGCATT | GACAT | GAGTGAGAT | X | | | |
| 4 | 2 | 2 | AGCATGGTC | AGGTTC | CAGTGAGGG | X | | | |
| 4 | 2 | 2 | AGCTGCATC | ACCTT | GAGTGAGTC | X | | | |
| 4 | 2 | 2 | AGAACGTC | CAGGTA | GAGTGAAAA | X | | | |
| 4 | 2 | 2 | TGCAGTGTC | CCATG | GAGGGAGGT | X | | | |
| 4 | 2 | 2 | AACAACGTC | CAGCAG | GAGTGTGAA | X | | | |
| 4 | 2 | 2 | AGCAAGGTC | TTAAA | GAGCGAGTA | X | | | |
| 4 | 2 | 2 | AGCAGTGTG | GGGCA | GTGTGAGGC | X | | | |
| 4 | 2 | 2 | AGTAGTGTC | CTGTG | GAGGGAGGC | X | | | |
| 4 | 2 | 2 | AGCAGGGTT | GGTTTC | TAGTGAGGC | X | | | |
| 4 | 2 | 2 | AGCATGGTC | AGGTTC | CAGTGAGGG | X | | | |
| 4 | 2 | 2 | AGCAGCATT | GACAT | GAGTGAGAT | X | | | |
| 4 | 2 | 2 | AGCACCGTA | TTCTGC | TAGTGAGGG | X | | | |
| 4 | 2 | 2 | AGCTGTGTC | TGGTGT | GAGTGAGAG | X | | | |
| 4 | 2 | 2 | AGCCGGGTC | CCCAC | GAGTGAGTG | X | | | |
| 4 | 2 | 2 | AACAGGGTC | AGAGAA | GAGTGAGAC | X | | | |
| 4 | 2 | 2 | AGCACTGTC | TTGGA | AAGTGAGGG | X | | | |
| 4 | 2 | 2 | AGCAACGTG | GCAGAG | GAGGGAGGT | X | | | |
| 4 | 2 | 2 | AGCAGGGTG | GGAACT | GAGGGAGGT | X | | | |
| 4 | 2 | 2 | AGCACAGTC | TTGGG | GAGAGAGGC | X | | | |
| 4 | 2 | 2 | AGCATTGTC | ACACA | GAGTGAATA | X | | | |
| 4 | 2 | 2 | ATCAGAGTC | AGCTTA | GAGTGAGAG | X | | | |
| 4 | 2 | 2 | AGCAACCTC | CAGGT | GAGGGAGGC | X | | | |
| 4 | 2 | 2 | AGCGGAGTC | GCTGGG | GAGAGAGGG | X | | | |
| 4 | 2 | 2 | AGCATGGTC | CATTTC | TAGTGAGGC | X | | | |
| 4 | 2 | 2 | TGCAGTGTC | CACAGC | AAGTGAGGT | X | | | |
| 4 | 2 | 2 | GGCACCGTC | CTCCTG | GAGGGAGGC | X | | | |
| 4 | 2 | 2 | AGCAAAGTC | TCTAAA | GAGTGTGGT | X | | | |
| 4 | 2 | 2 | AGCAGCATT | GACAT | GAGTGAGAT | X | | | |
| 4 | 2 | 2 | AGCAGCATT | GCACGG | GGGTGAGGT | X | | | |
| 4 | 2 | 2 | AGCAGTGAC | AGCGG | GAGTGAGCC | X | | | |
| 4 | 2 | 2 | AGCAGTGAC | CAATCT | GAGTGAGCC | X | | | |
| 4 | 2 | 2 | AGCAATGTC | AACAGA | GGGTGAGGG | X | | | |
| 4 | 2 | 2 | AGCAACATC | TACTAA | GAGTGAGCC | X | | | |
| 4 | 2 | 2 | TGCAGGGTC | AGGGT | GTGTGAGGC | X | | | |
| 4 | 2 | 2 | AGCAACGGC | GACTG | GAGTGACCA | X | | | |
| 4 | 2 | 2 | AGCATGGTC | CAGTTC | CAGTGAGGG | X | | | |
| 4 | 2 | 2 | GGCAGTGTC | CTCCCA | CAGTGAGGC | X | | | |
| 4 | 2 | 2 | AGCACCGGC | CCTGGG | CAGTGAGGG | X | | | |
| 4 | 2 | 2 | AACAGTGTC | TATAAA | TAGTGAGGG | X | | | |
| 4 | 2 | 2 | AGCAAAGTC | AGAGG | GAGTGATGT | X | | | |
| 4 | 2 | 2 | AGCAATGTC | TGCAT | GAGGGAGGT | X | | | |
| 4 | 2 | 2 | AGCAGTCTC | CAGGC | GAGAGAGGG | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 4 | 2 | 2 | AGCAAAGTC | CTTGGT | AAGTGAGGG | X | | | |
| 4 | 2 | 2 | AGCAGCAGC | TTAGA | GAGTGAGCC | X | | | |
| 4 | 2 | 2 | AACATCGTC | AGTGG | GAGTGTGAA | X | | | |
| 4 | 2 | 2 | AGCAACATC | CTTGGG | GAGTGAAGT | X | | | |
| 4 | 2 | 2 | AGCCCCGTC | AAGCA | GAGGGAGGC | X | | | |
| 4 | 2 | 2 | AGCAGCGGT | TCTCA | GAGTGTGGC | X | | | |
| 4 | 2 | 2 | AGCAAGGTC | TGAGAA | GAGTGGTGA | X | | | |
| 4 | 2 | 2 | AACAGAGTC | AGAGAG | GTGTGAGGC | X | | | |
| 4 | 2 | 2 | GGCAGCGTG | TGACAG | AAGTGAGGG | X | | | |
| 4 | 2 | 2 | AGCATAGTC | TCCCA | GAGTGAGTG | X | | | |
| 4 | 2 | 2 | AGCCGTGTC | CCCTT | AAGTGAGGG | X | | | |
| 4 | 2 | 2 | AGCATGGTC | AGGTT | CAGTGAGGG | X | | | |
| 4 | 2 | 2 | AGTAGTGTC | TGGTG | GAGTGAGTT | X | | | |
| 4 | 2 | 2 | AGCAGCATT | GACAT | GAGTGAGAT | X | | | |
| 4 | 2 | 2 | AGCAGCATT | TCAAGA | GAGTGAGAG | X | | | |
| 4 | 2 | 2 | CGCAGTGTC | TGGTCA | CAGTGAGGC | X | | | |
| 4 | 2 | 2 | AGCAGGGTG | GGGAA | GAGGGAGGT | X | | | |
| 4 | 2 | 2 | AGCAGGGTA | ATGTGA | GAGTGAGTG | X | | | |
| 4 | 2 | 2 | AGCATAGTC | ACTTA | GAGTGTGGG | X | | | |
| 4 | 2 | 2 | AGCATGGTC | AGGTTC | CAGTGAGGG | X | | | |
| 4 | 2 | 2 | TCCAGCGTC | GTGACA | GAGTGAGAC | X | | | |
| 4 | 2 | 2 | AGCACTGTC | CTGTCA | GAGTGTGGC | X | | | |
| 4 | 2 | 2 | AGCATAGTC | CAGTT | CAGTGAGGC | X | | | |
| 4 | 2 | 2 | AGCAGTGTG | CACCAC | GAGAGAGGC | X | | | |
| 4 | 2 | 2 | AGCAACGGC | AGGAGA | GAGAGGGA | X | | | |
| 4 | 2 | 2 | AGCCGGGTC | ACCGA | GAGTGAGTG | X | | | |
| 4 | 2 | 2 | AGCAATGTC | AATTTT | CAGTGAGCA | X | | | |
| 4 | 2 | 2 | AGCAACGTG | TGGAG | CAGTGAGGG | X | | | |
| 4 | 2 | 2 | AGCACGGTC | AGTCTT | CAGTGAGGG | X | | | |
| 4 | 2 | 2 | AGCATGGTC | ATGTTA | TAGTGAGTA | X | | | |
| 4 | 2 | 2 | AGCAGGGTA | GGGAG | GAGTGAGTG | X | | | |
| 4 | 2 | 2 | AGCGGTGTC | TGAAAA | AAGTGAGGG | X | | | |
| 4 | 2 | 2 | AGCAAGGTC | CATCCA | GAGAGAGGC | X | | | |
| 4 | 2 | 2 | AGCACCTTC | TAGGGA | GTGTGAGGC | X | | | |
| 4 | 2 | 2 | AGCAAAGTC | TCACAG | GAGGGAGGC | X | | | |
| 4 | 2 | 2 | AGCAAGGTC | TGGGA | GAGTGATGT | X | | | |
| 4 | 2 | 2 | AGCAGCAGC | TGCCGG | GAGCGAGGC | X | | | |
| 4 | 2 | 2 | AGCAACGGC | CTGGG | GAGTGTGGG | X | | | |
| 4 | 2 | 2 | TGCAGCGAC | TGAAGT | GAGTGAGTG | X | | | |
| 4 | 2 | 2 | GGCAGCTTC | CCAGT | GAGTAAGGT | X | | | |
| 4 | 2 | 2 | AACAGTGTC | AGTGAT | TAGTGAGGG | X | | | |
| 4 | 2 | 2 | AGCTTCGTC | CAGAG | CAGTGAGGG | X | | | |
| 4 | 2 | 2 | AGCAGCATT | GACAT | GAGTGAGAT | X | | | |
| 4 | 2 | 2 | AGCAACGTG | ATGAAA | GAGTGAGAT | X | | | |
| 4 | 2 | 2 | AGCAATGTC | AGTCTC | AAGTGTGGA | X | | | |
| 4 | 2 | 2 | TGCAGTGTC | CCTGG | GAGGGAGGT | X | | | |
| 4 | 2 | 2 | AGCAACGGC | CAGTCC | CAGGGAGGA | X | | | |
| 4 | 2 | 2 | AGCATCGGC | TCCTC | AAGTGAGGC | X | | | |
| 4 | 2 | 2 | AGCATCGGC | TCCTC | AAGTGAGGC | X | | | |
| 4 | 2 | 2 | AGCATCGGC | TCCTC | AAGTGAGGC | X | | | |
| 4 | 2 | 2 | AGCAAGGTC | AGAGA | GTGTGAGGC | X | | | |
| 4 | 2 | 2 | AGCGGAGTC | CAGAG | AAGTGAGGG | X | | | |
| 4 | 2 | 2 | AGCACCATC | AGCAC | CAGTGAGGT | X | | | |
| 4 | 2 | 2 | AGCTGCTTC | CCCTA | GAGTGAGAG | X | | | |
| 4 | 2 | 2 | AGCAACATC | ACTTT | GAGTAAGGC | X | | | |
| 4 | 2 | 2 | AACAGTGTC | AAATC | AAGTGAGGT | X | | | |
| 4 | 2 | 2 | AGCATCGTA | CCTCAA | GAGACAGGA | X | | | |
| 4 | 2 | 2 | AGCATGGTC | GGTTTC | CAGTGAGGG | X | | | |
| 4 | 2 | 2 | AACAGCTTC | CCAGCT | TAGTGAGGC | X | | | |
| 4 | 2 | 2 | AGCAACTTC | CCTGGA | GGGTGAGGG | X | | | |
| 4 | 2 | 2 | AGCAGCATT | GACAT | GAGTGAGAT | X | | | |
| 4 | 2 | 2 | AGCAGGGTG | GGGTGT | GAGGGAGGC | X | | | |
| 4 | 2 | 2 | AGCATTGTC | TGAAG | GAGAGGGGA | X | | | |
| 4 | 2 | 2 | GGCAGCGTG | TGTGA | GAGTGAGCT | X | | | |
| 4 | 2 | 2 | AGCTGTGTC | CCCCA | GAGTGAGAG | X | | | |
| 4 | 2 | 2 | AGCAGCATT | CATGT | GAGTGAGAT | X | | | |
| 4 | 2 | 2 | AGCAGTGTT | TCTTC | GAGTGTGGC | X | | | |
| 4 | 2 | 2 | AGCACAGTC | ACCGA | TAGTGAGGC | X | | | |
| 4 | 2 | 2 | GGCAGCTTC | AGGGC | AAATGAGGA | X | | | |
| 4 | 2 | 2 | AGCATTGTC | ATAATA | GAGAGAGGT | X | | | |
| 4 | 2 | 2 | AGCATGGTC | ATGGA | AAGTGAGTA | X | | | |
| 4 | 2 | 2 | AGCAGGGTG | GTAAA | GAGGGAGGT | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 4 | 2 | 2 | AGCAACTTC | TCCAC | TAGTGAGGG | X | | | |
| 4 | 2 | 2 | AGCAGCAGC | CGGTG | GTGTGAGGC | X | | | |
| 4 | 2 | 2 | TGCAGGGTC | TCTTA | GAGTGAGTT | X | | | |
| 4 | 2 | 2 | TGCAGCGTT | GGGCT | CAGTGAGGG | X | | | |
| 4 | 2 | 2 | AGCAGCATA | TAATA | GAGTGAGTC | X | | | |
| 4 | 2 | 2 | AGCAGTGTG | CTAAG | GAGAGAGGC | X | | | |
| 4 | 2 | 2 | AACAGCATC | TCAGCT | GGGTGAGGC | X | | | |
| 4 | 2 | 2 | AGCAGTGTG | CCTTGG | GTGTGAGGG | X | | | |
| 4 | 2 | 2 | AACAGAGTC | GTTCA | GTGTGAGGC | X | | | |
| 4 | 2 | 2 | AGCAACGTT | AGCAG | GAGTGTGGT | X | | | |
| 4 | 2 | 2 | AGCAAAGTC | TGTAAA | GAGTGTGTA | X | | | |
| 4 | 2 | 2 | TGCATCGTC | CTATG | GAGGGAGGT | X | | | |
| 4 | 2 | 2 | AGCAAGGTC | TTGTTG | GAGGGAGGG | X | | | |
| 4 | 2 | 2 | GGCACCGTC | ATCCT | GAGTGGGGC | X | | | |
| 4 | 2 | 2 | AGCAGAGTA | AGGGAG | GAGTGAGAG | X | | | |
| 4 | 2 | 2 | AGCAAAGTC | ACAGG | GAGTGAGCG | X | | | |
| 4 | 2 | 2 | AGAAGTGTC | ACTGTC | CAGTGAGGC | X | | | |
| 4 | 2 | 2 | AGCAGCATT | GACAT | GAGTGAGAT | X | | | |
| 4 | 2 | 2 | AGCAAAGTC | AGCCA | GAGGGAGAA | X | | | |
| 4 | 2 | 2 | AGCAAAGTC | TGGAGT | GAGTGTGTA | X | | | |
| 4 | 2 | 2 | GGCAGTGTC | CGGCT | GAGGGAGGG | X | | | |
| 4 | 2 | 2 | AGCAGCAAC | AGTGT | GAGTGAGTT | X | | | |
| 4 | 2 | 2 | AGCATTGTC | TAGCA | GGGTGAGAA | X | | | |
| 4 | 2 | 2 | AGCAAGGTC | ACTGAG | GAGGGAGGC | X | | | |
| 4 | 2 | 2 | AGCATCGGC | AGCTTG | GAGAGAGGT | X | | | |
| 4 | 2 | 2 | AGCAGGGTG | GTAGGG | GAGGGAGGT | X | | | |
| 4 | 2 | 2 | AGCAGCGCT | TCTCA | AAGTGAGGC | X | | | |
| 4 | 2 | 2 | AGCAGGGTG | GTGTGA | GAGTGAGTG | X | | | |
| 4 | 2 | 2 | TGCAGCGTG | GCCACA | GAGTGAGAC | X | | | |
| 4 | 2 | 2 | TGCAGTGTC | ATTTGA | GAGTAAGGT | X | | | |
| 4 | 2 | 2 | AGCAGGGTG | AGCACT | AAGTGAGGC | X | | | |
| 4 | 2 | 2 | AACAGGGTC | AGTGGG | GAGAGAGGC | X | | | |
| 4 | 2 | 2 | AACAGCGGC | CTATT | GTGTGAGGG | X | | | |
| 4 | 2 | 2 | AGCAACGTT | CAGCT | CAGTGAGGT | X | | | |
| 4 | 2 | 2 | AGCAGTGTT | GCCCCA | GGGTGAGGT | X | | | |
| 4 | 2 | 2 | AGCACCGTG | TGGGGA | GAGGGAGGT | X | | | |
| 4 | 2 | 2 | AGCAACGTT | CTGTG | GAATGAGCA | X | | | |
| 4 | 2 | 2 | AGCCACGTC | GAATG | GATTGAGGG | X | | | |
| 4 | 2 | 2 | AGCAGGGTG | GAGCGC | GAGGGAGGC | X | | | |
| 4 | 2 | 2 | TGCAGCGGC | CTCAG | AAGTGAGGG | X | | | |
| 4 | 2 | 2 | AGCATTGTC | TCCCTT | GAGTATGGA | X | | | |
| 4 | 2 | 2 | GGCACCGTC | CTTTG | CAGTGAGGT | X | | | |
| 4 | 2 | 2 | AGCATGGTC | GGGCAC | TAGTGAGGC | X | | | |
| 4 | 2 | 2 | AGCACCATC | ATGAAT | GTGTGAGGC | X | | | |
| 4 | 2 | 2 | AGTAGTGTC | TAATAG | GTGTGAGGT | X | | | |
| 4 | 2 | 2 | AGCACCATC | AAGATA | GTGTGAGGC | X | | | |
| 4 | 2 | 2 | AGCCACGTC | ACCTG | AGGTGAGGA | X | | | |
| 4 | 2 | 2 | AGCAACATC | TGTGTA | GAGCGAGGT | X | | | |
| 4 | 2 | 2 | AGCCGAGTC | CTTGT | GGGTGAGGC | X | | | |
| 4 | 2 | 2 | ACCAGTGTC | CTGCAG | TAGTGAGGC | X | | | |
| 4 | 2 | 2 | AGCAACGAC | GGGCT | GCGTGTGGA | X | | | |
| 4 | 2 | 2 | AGCAGCATT | GACCT | GAGTGAGAT | X | | | |
| 4 | 2 | 2 | AGCAGCATT | GACCT | GAGTGAGAT | X | | | |
| 4 | 2 | 2 | CGCAGTGTC | TTCCC | CAGTGAGGC | X | | | |
| 4 | 2 | 2 | TGCATCGTC | AGAGA | GTGTGAGGG | X | | | |
| 4 | 2 | 2 | AGCTGAGTC | CCCGGC | AAGTGAGGC | X | | | |
| 4 | 2 | 2 | AGCAACGTG | TGCCA | GTGTGAGGG | X | | | |
| 4 | 2 | 2 | AGCAGTGGC | TGGGCA | TAGTGAGGC | X | | | |
| 4 | 2 | 2 | AGCAGCATT | GACAT | GAGTGAGAT | X | | | |
| 4 | 2 | 2 | AGCACCATC | TAGGCA | GAGGGAGGC | X | | | |
| 4 | 2 | 2 | AGCACAGTC | ATGGTG | GAGTAAGGG | X | | | |
| 4 | 2 | 2 | AGCATGGTC | AGGTTC | CAGTGAGGG | X | | | |
| 4 | 2 | 2 | AGCATGGTC | AGGTTC | CAGTGAGGG | X | | | |
| 4 | 2 | 2 | AGTAACGTC | ATTTCA | GAGTGCAGA | X | | | |
| 4 | 2 | 2 | AGCAACTTC | TAGGAT | GAGTGTGAA | X | | | |
| 4 | 2 | 2 | AGCAGCATT | GACAT | GAGTGAGAT | X | | | |
| 4 | 2 | 2 | AGCAATGTC | TGCTGT | GGGTGAGGG | X | | | |
| 4 | 2 | 2 | AGCAATGTC | TGCCAT | GAGTGTGAA | X | | | |
| 4 | 2 | 2 | AGCAGATTC | GGAATT | GAGTGAGTG | X | | | |
| 4 | 2 | 2 | CACAGCGTC | GGAGG | GAGGGAGGG | X | | | |
| 4 | 2 | 2 | AGCAGCGAT | CTAAT | GAGGGAGAA | X | | | |
| 4 | 2 | 2 | AGCACCGTG | AGACTT | GAGTGAGCC | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 4 | 2 | 2 | ATCAGTGTC | CTGGG | GAGTGTGGT | X | | | |
| 4 | 2 | 2 | AGCAACCTC | ACGGG | GAGGGAGGC | X | | | |
| 4 | 2 | 2 | AGCAACTTC | AGAAGT | GAGTTAGGG | X | | | |
| 4 | 2 | 2 | AGCAACTTC | CACTA | GAGAGAGGC | X | | | |
| 4 | 2 | 2 | AGCAACGTG | GCAGAT | GAGAGAGGT | X | | | |
| 4 | 2 | 2 | AACAGCATC | AAATGC | GGGTGAGGC | X | | | |
| 4 | 2 | 2 | ACAAGCGTC | TGTAA | GAGTGAGTC | X | | | |
| 4 | 2 | 2 | TCCAGCGTC | ACCTA | AAGTGAGGG | X | | | |
| 4 | 2 | 2 | AGCAAGGTC | AGGAA | GAGAGAGGC | X | | | |
| 4 | 2 | 2 | AGTAGCGTT | TTGTC | CAGTGAGGT | X | | | |
| 4 | 2 | 2 | AGCAGTGTT | TGCTAA | CAGTGAGGC | X | | | |
| 4 | 2 | 2 | AGCATGGTC | AGGTTC | CAGTGAGGG | X | | | |
| 4 | 2 | 2 | AGCAGCGGA | GGTCA | GAGTGAGTT | X | | | |
| 4 | 2 | 2 | AGCACCGAC | TCCAT | CAGTGAGGT | X | | | |
| 4 | 2 | 2 | AGCAGTGAC | ATGAG | GAGTGAGCC | X | | | |
| 4 | 2 | 2 | AGCAGGGTT | TCTGCA | GTGTGAGGT | X | | | |
| 4 | 2 | 2 | AGCAGCATG | GTTAG | GAGTGAGAT | X | | | |
| 4 | 2 | 2 | ATCAGAGTC | AAAGG | GAGGGAGGC | X | | | |
| 4 | 2 | 2 | AGCAGGGTT | GGAAGA | AAGTGAGGG | X | | | |
| 4 | 2 | 2 | AGCAGGGTG | GGCAA | GAGGGAGGC | X | | | |
| 4 | 2 | 2 | GGCAGTGTC | TCAAAC | GAGGGAGGG | X | | | |
| 4 | 2 | 2 | GGCATCGTC | ACTCTT | GAGTGAGAG | X | | | |
| 4 | 2 | 2 | AGCACCGTG | ACTTC | GAGGGAGGT | X | | | |
| 4 | 2 | 2 | AGCAGAGTT | TAAAA | TAGTGAGGG | X | | | |
| 4 | 3 | 1 | GACAGCCTC | ATTAT | GAGTGAGGC | X | | | |
| 4 | 3 | 1 | AGGGGGGTC | TTGGGA | GAGTGAGGT | X | | | |
| 4 | 3 | 1 | AGCCTGGTC | CGTGA | GTGTGAGGA | X | | | |
| 4 | 3 | 1 | GGCAGCGAT | GAGATT | GAGTGAGGG | X | | | |
| 4 | 3 | 1 | AACAAGGTC | ATAAA | GAGGGAGGA | X | | | |
| 4 | 3 | 1 | AGCTGAGAC | TTAGA | GAGTGAGGT | X | | | |
| 4 | 3 | 1 | AGCTGAGAC | TTAGA | GAGTGAGGT | X | | | |
| 4 | 3 | 1 | GGCAGAGTG | GAGGAA | GAGTGAGGC | X | | | |
| 4 | 3 | 1 | AGCTGGGTT | GGAGTG | GAGTGAGGG | X | | | |
| 4 | 3 | 1 | AGCAAAGGC | TAAAGA | GTGTGAGGA | X | | | |
| 4 | 3 | 1 | AGTAACGGC | GGGGCT | GAGGGAGGA | X | | | |
| 4 | 3 | 1 | AGCATTGTT | CTCAG | AAGTGAGGA | X | | | |
| 4 | 3 | 1 | CACAGCATC | AGCAG | GAGTGAGGG | X | | | |
| 4 | 3 | 1 | AGCCACATC | AGTCT | GAGTAAGGA | X | | | |
| 4 | 3 | 1 | AGCAGCACA | CAGGCC | GAGTGAGGT | X | | | |
| 4 | 3 | 1 | AGCATTGCC | TTTTG | GAGTGAGGG | X | | | |
| 4 | 3 | 1 | AGAAGTGCC | ATCTGG | GAGTGAGGG | X | | | |
| 4 | 3 | 1 | ATCAGCATA | CAGGG | GAGTGAGGC | X | | | |
| 4 | 3 | 1 | AGCAGGTAC | GTGCCT | GAGTGAGGC | X | | | |
| 4 | 3 | 1 | AACTACGTC | CACCA | GAGTGGGGA | X | | | |
| 4 | 3 | 1 | AGAAGTGCC | ATCTAG | GAGTGAGGG | X | | | |
| 4 | 3 | 1 | AGGAGTCTC | ATACT | GAGTGAGGT | X | | | |
| 4 | 3 | 1 | TCCAGCGGA | CACAG | GAGTGAGGT | X | | | |
| 4 | 3 | 1 | AGCTCAGTC | TCCCA | GGGTGAGGA | X | | | |
| 4 | 3 | 1 | AGCTCAGTC | TCTCA | GGGTGAGGA | X | | | |
| 4 | 3 | 1 | AACAGTATC | TATTCT | GAGTGAGGC | X | | | |
| 4 | 3 | 1 | GGAAGTGTC | TTACTG | GAGTGAGGT | X | | | |
| 4 | 3 | 1 | CTCAGAGTC | AAACA | GAGTGAGGT | X | | | |
| 4 | 3 | 1 | AACAGTGTT | TTGGCC | GAGTGAGGG | X | | | |
| 4 | 3 | 1 | CTCAGCTTC | CTGTG | GAGTGAGGC | X | | | |
| 4 | 3 | 1 | AGCAGCTGT | AGGGA | GAGTGAGGT | X | | | |
| 4 | 3 | 1 | AGCTGTGTG | ATCCT | GAGTGAGGG | X | | | |
| 4 | 3 | 1 | AGGTGTGTC | TTTGGA | GAGTGAGGC | X | | | |
| 4 | 3 | 1 | ATTAGAGTC | TGGGTT | GGGTGAGGA | X | | | |
| 4 | 3 | 1 | AGCCGGCTC | GCGAGT | GAGTGAGGG | X | | | |
| 4 | 3 | 1 | AGCACCAGC | CCGGGT | GAGTGAGGT | X | | | |
| 4 | 3 | 1 | TTCAGCGTT | GTGAA | GAGTGAGGC | X | | | |
| 4 | 3 | 1 | AGCTCCTTC | GAGGA | GAGTGAGGC | X | | | |
| 4 | 3 | 1 | AAGAGTGTC | CTGGTT | GAGTGAGGC | X | | | |
| 4 | 3 | 1 | TGCAGGGTA | GTTGG | GAGTGAGGT | X | | | |
| 4 | 3 | 1 | AGGATCATC | CAGAGT | GAGTGAGGC | X | | | |
| 4 | 3 | 1 | GTCTGCGTC | CGAAGG | GAGTGAGGG | X | | | |
| 4 | 3 | 1 | ATGAGCGAC | TGATG | GAGTGAGGG | X | | | |
| 4 | 3 | 1 | CCCAGGGTC | CACAGA | GAGTGAGGC | X | | | |
| 4 | 3 | 1 | AGTACAGTC | CATTTG | GAGGGAGGA | X | | | |
| 4 | 3 | 1 | AGCTTCCTC | CATCTT | GAGTGAGGG | X | | | |
| 4 | 3 | 1 | AGAAGTGCC | TCCTG | GAGTGAGGG | X | | | |
| 4 | 3 | 1 | GGCAGAGTG | GATCA | GAGTGAGGC | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 4 | 3 | 1 | AGCAGTTCC | TAAAA | GAGTGAGGG | X | | | |
| 4 | 3 | 1 | GGCACTGTC | GCTCA | GAGTGAGGT | X | | | |
| 4 | 3 | 1 | AGCAGGCAC | AGCCTG | GAGTGAGGC | X | | | |
| 4 | 3 | 1 | AGTGGAGTC | CCCTA | GAGTGAGAA | X | | | |
| 4 | 3 | 1 | AGGACAGTC | GCAGA | GAGTGAGGC | X | | | |
| 4 | 3 | 1 | AGCTGTGTG | CTGCCA | GAGTGAGGC | X | | | |
| 4 | 3 | 1 | AGCAAGGTG | GGTGGC | GTGTGAGGA | X | | | |
| 4 | 3 | 1 | TGCTGTGTC | CCCAGT | GAGTGAGGG | X | | | |
| 4 | 3 | 1 | GGCACAGTC | TGACA | GAGAGAGGA | X | | | |
| 4 | 3 | 1 | AGCTCAGTC | TCACA | GGGTGAGGA | X | | | |
| 4 | 3 | 1 | GTCAGTGTC | ATGCTT | GAGTGAGGC | X | | | |
| 4 | 3 | 1 | GGAAGGGTC | CCAGTG | GAGTGAGGT | X | | | |
| 4 | 3 | 1 | AGGAGCAAC | AAAGA | GAGTGAGGG | X | | | |
| 4 | 3 | 1 | AGCGGTTTC | AGTGA | GAGTGAGGC | X | | | |
| 4 | 3 | 1 | AGCAGCACG | GGGTG | AAGTGAGGA | X | | | |
| 4 | 3 | 1 | AGAAGGGTG | GAGAAG | GAGTGAGGT | X | | | |
| 4 | 3 | 1 | TGCTGTGTC | CATCCA | GAGTGAGGG | X | | | |
| 4 | 3 | 1 | AGCTCAGTC | AACTG | GGGTGAGGA | X | | | |
| 4 | 3 | 1 | AGCAAGGTT | AGGTTC | TAGTGAGGA | X | | | |
| 4 | 3 | 1 | AGCTCAGTC | TCTCA | GGGTGAGGA | X | | | |
| 4 | 3 | 1 | AGCACGGTG | GTCAA | GAGTGAGGC | X | | | |
| 4 | 3 | 1 | AGCAGGGAT | TTGCA | GAGTGAGGC | X | | | |
| 4 | 3 | 1 | ATCAGCTTT | GGGGTT | GAGTGAGGT | X | | | |
| 4 | 3 | 1 | AGCACAGAC | AGCAT | GAGTGAGGC | X | | | |
| 4 | 3 | 1 | CCCAGCTTC | TCAGG | GAGTGAGGC | X | | | |
| 4 | 3 | 1 | CGCCCCGTC | TGGGA | AAGTGAGGA | X | | | |
| 4 | 3 | 1 | AGCAGAGGT | TCCCA | GAGTGAGGC | X | | | |
| 4 | 3 | 1 | AGCCACCTC | CCCTGC | GAGTAAGGA | X | | | |
| 4 | 3 | 1 | AGCCCTGTC | TGTTAA | GAGTGAGGT | X | | | |
| 4 | 3 | 1 | AGCAGCAGT | CTCTG | GAGTGAGGT | X | | | |
| 4 | 3 | 1 | AGCCACTTC | TAGGGA | GAGTGAGTA | X | | | |
| 4 | 3 | 1 | AGGTGCGGC | AGGTA | GAGTGAGGG | X | | | |
| 4 | 3 | 1 | AGCTGTGTG | GTTGG | GAGTGAGGG | X | | | |
| 4 | 3 | 1 | AGGCGCTTC | ATTTAT | GAGTGAGGT | X | | | |
| 4 | 3 | 1 | AGGAGTCTC | ACGATA | GAGTGAGGT | X | | | |
| 4 | 3 | 1 | ATCATCCTC | CGCACT | GAGTGAGGG | X | | | |
| 4 | 3 | 1 | AGCCGGGTA | GGGGAT | GAGTGAGGC | X | | | |
| 4 | 3 | 1 | AGCAACTGC | TTTGTG | GAGTGAGGT | X | | | |
| 4 | 3 | 1 | GGCAGCATT | TGAAGG | GAGTGAGGG | X | | | |
| 4 | 3 | 1 | CACAGCATC | TGAGGT | GAGTGAGGG | X | | | |
| 4 | 3 | 1 | AGCTGAGAC | TTAGA | GAGTGAGGT | X | | | |
| 4 | 3 | 1 | ACCCGTGTC | ACAGTT | GAGTGAGGG | X | | | |
| 4 | 3 | 1 | AGCCCTGTC | TGCTGG | GAGTGAGGG | X | | | |
| 4 | 3 | 1 | GGACGCGTC | AGGCT | GAGTGAGGT | X | | | |
| 4 | 3 | 1 | AGGAACCTC | GTGCG | GAGTGAGGC | X | | | |
| 4 | 3 | 1 | AGCTGTGTG | GCCTT | GAGTGAGGC | X | | | |
| 4 | 3 | 1 | CGCTGCGAC | CTTCA | GAGTGAGGC | X | | | |
| 4 | 3 | 1 | GGTAGAGTC | AGACA | GAGTGAGGG | X | | | |
| 4 | 3 | 1 | AGCTGAGAC | TTAGA | GAGTGAGGT | X | | | |
| 4 | 3 | 1 | ACCAACCTC | CTGTCA | GAGTGAGGC | X | | | |
| 4 | 3 | 1 | AGCAGTCTG | CTGCAG | GAGTGAGGG | X | | | |
| 4 | 3 | 1 | TGCTGTGTC | CTCACA | TAGTGAGGA | X | | | |
| 4 | 3 | 1 | AGAAACTTC | AAGAAG | GAGTGAGGT | X | | | |
| 4 | 3 | 1 | AACAATGTC | GTCACA | GAGTGAGTA | X | | | |
| 4 | 3 | 1 | AGAAGGGTG | AATAAG | GAGTGAGGT | X | | | |
| 4 | 3 | 1 | TGCAGCGGA | GGCAG | GAGTGAGGG | X | | | |
| 4 | 3 | 1 | AGCTGTGTG | ACCTC | GAGTGAGGC | X | | | |
| 4 | 3 | 1 | AATAGAGTC | CTGGG | GAGTGAGGC | X | | | |
| 4 | 3 | 1 | AGCTGAGAC | TTAGA | GAGTGAGGT | X | | | |
| 4 | 3 | 1 | AGCTGAGAC | TTAGA | GAGTGAGGT | X | | | |
| 4 | 3 | 1 | AGTAGCATT | TTTAGT | GAGTGAGGG | X | | | |
| 4 | 3 | 1 | ACCGGAGTC | ATCCCT | GAGTGAGGG | X | | | |
| 4 | 3 | 1 | AGCAGTCTG | AAGGG | GAGTGAGGG | X | | | |
| 4 | 3 | 1 | AGCAGCACA | CAGGCC | GAGTGAGGT | X | | | |
| 4 | 3 | 1 | AGCAGCCAT | CAGAG | GAGTGAGGC | X | | | |
| 4 | 3 | 1 | GCCAGGGTC | CAAATG | GAGTGAGGC | X | | | |
| 4 | 3 | 1 | AGCATCTTA | GTGAT | GAGTGAGGT | X | | | |
| 4 | 3 | 1 | AGGAGCAAC | AGAGA | GAGTGAGGG | X | | | |
| 4 | 3 | 1 | AGCAGGTTT | ATTAGG | GAGTGAGGG | X | | | |
| 4 | 3 | 1 | GACAGCCTC | TCCCA | GAGTGAGGC | X | | | |
| 4 | 3 | 1 | AGCAGCAAT | GGCAG | GAGTGAGGT | X | | | |
| 4 | 3 | 1 | GGCAGCGGT | AGAGA | TAGTGAGGA | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 4 | 3 | 1 | AGTGGAGTC | CTGGA | GAGTGAGTA | X | | | |
| 4 | 3 | 1 | AGCCTGGTC | TGGCC | GTGTGAGGA | X | | | |
| 4 | 3 | 1 | AGAACCGAC | CAGCCA | GAGTGAGGG | X | | | |
| 4 | 3 | 1 | AGCAACATG | ACCCA | GAGTGAGGG | X | | | |
| 4 | 3 | 1 | AGCTCAGTC | TTGCA | GGGTGAGGA | X | | | |
| 4 | 3 | 1 | AGCTCAGTC | TCACA | GGGTGAGGA | X | | | |
| 4 | 3 | 1 | TGCAATGTC | AAGCTT | GAGTGAGAA | X | | | |
| 4 | 3 | 1 | GGCCCCGTC | ACGGT | GAGTGAGGG | X | | | |
| 4 | 3 | 1 | AGCTCAGTC | TCACA | GGGTGAGGA | X | | | |
| 4 | 3 | 1 | AGCAATGTA | GGGAGG | GAGTGAGGG | X | | | |
| 4 | 3 | 1 | AGTAACATC | CTGTTT | GTGTGAGGA | X | | | |
| 4 | 3 | 1 | ATCATTGTC | TCCACT | GAGTGAGAA | X | | | |
| 4 | 3 | 1 | AGTAGAGTT | TAGGG | GAGTGAGGG | X | | | |
| 4 | 3 | 1 | AGCAGGGGT | CAGCTG | GAGTGAGGG | X | | | |
| 4 | 3 | 1 | TGCTGTGTC | TTCCTG | GAGTGAGGC | X | | | |
| 4 | 3 | 1 | ATTAGAGTC | AGAGCA | GGGTGAGGA | X | | | |
| 4 | 3 | 1 | AGAAGGGTG | AGCAA | GAGTGAGGT | X | | | |
| 4 | 3 | 1 | CTCAGTGTC | TCTGTG | AAGTGAGGA | X | | | |
| 4 | 3 | 1 | AGCTGTGTT | CTGGAT | GAGTGAGGT | X | | | |
| 4 | 3 | 1 | AGTACAGTC | TAGCCA | GAGGGAGGA | X | | | |
| 4 | 3 | 1 | AGCCGCTTT | ATTCAA | GAGTGAGGG | X | | | |
| 4 | 3 | 1 | ACCGGTGTC | GTCGT | GAGTGAGGG | X | | | |
| 4 | 3 | 1 | AGCAGTGCT | GAGGC | GAGTGAGGC | X | | | |
| 4 | 3 | 1 | AGCTCAGTC | TCACA | GGGTGAGGA | X | | | |
| 4 | 3 | 1 | ATCTGCATC | TCTCTT | GAGTGAGGT | X | | | |
| 4 | 3 | 1 | AGCACAATC | CCCCAA | GAGTGAGGG | X | | | |
| 4 | 3 | 1 | AGCTCAGTC | TCACA | GGGTGAGGA | X | | | |
| 4 | 3 | 1 | ATCATCATC | TTGGA | GAGTGAGGC | X | | | |
| 4 | 3 | 1 | GGTAGAGTC | ACTGTA | GAGTGAGGG | X | | | |
| 4 | 3 | 1 | AGCTGTGTG | CTGGGG | GAGTGAGGC | X | | | |
| 4 | 3 | 1 | ATGAGTGTC | AGGTG | GAGTGAGGC | X | | | |
| 4 | 3 | 1 | GGCAGAGTG | GTCCAG | GAGTGAGGC | X | | | |
| 4 | 3 | 1 | AGGAGTCTC | CAGGGG | GAGTGAGGC | X | | | |
| 4 | 3 | 1 | AGCCAAGTC | CTGAG | GGGTGAGGA | X | | | |
| 4 | 3 | 1 | CGCTGAGTC | CAGAG | GAGTGAGGC | X | | | |
| 4 | 3 | 1 | GGCTCCGTC | TTATGT | GAGTGAGGC | X | | | |
| 4 | 3 | 1 | AGCAGCAGT | GAGGA | GAGTGAGGC | X | | | |
| 4 | 3 | 1 | AGTACTGTC | AACTA | CAGTGAGGA | X | | | |
| 4 | 3 | 1 | ATGAGCGGC | CGGTAG | GAGTGAGGT | X | | | |
| 4 | 3 | 1 | TGCAAGGTC | AGGAT | AAGTGAGGA | X | | | |
| 4 | 3 | 1 | AGTACAGTC | ACTGT | TAGTGAGGA | X | | | |
| 4 | 3 | 1 | ATCATTGTC | AGGTT | GAGTGAGAA | X | | | |
| 4 | 3 | 1 | CTCAGCGGC | TGCTGT | GAGTGAGGG | X | | | |
| 4 | 3 | 1 | AGCAGTCCC | ATCCAA | GAGTGAGGG | X | | | |
| 4 | 3 | 1 | AGCACAGGC | TGGACA | GAGTGAGGT | X | | | |
| 4 | 3 | 1 | AGCAACCAC | CTCCTG | GAGGGAGGA | X | | | |
| 4 | 3 | 1 | AGTAAGGTC | AAGGA | GAGGGAGGA | X | | | |
| 4 | 3 | 1 | CGCCCCGTC | TGGAG | AAGTGAGGA | X | | | |
| 4 | 3 | 1 | TGCACAGTC | ACATG | GTGTGAGGA | X | | | |
| 4 | 3 | 1 | AGCAGCAAG | TGGCA | GAGTGAGGC | X | | | |
| 4 | 3 | 1 | AGCTCAGTC | TCACA | GGGTGAGGA | X | | | |
| 4 | 3 | 1 | GGCAGGGTT | TCTCA | GAGTGAGGT | X | | | |
| 4 | 3 | 1 | AGGATGGTC | CTTCC | AAGTGAGGA | X | | | |
| 4 | 3 | 1 | AGCAACCCC | ATTTT | GAGTGAGGG | X | | | |
| 4 | 3 | 1 | AGAAGCCAC | ATCAGT | GAGTGAGGG | X | | | |
| 4 | 3 | 1 | ACCAATGTC | ACCTGT | GTGTGAGGA | X | | | |
| 4 | 3 | 1 | AGGTGCGTG | GAGTG | GAGTGAGGG | X | | | |
| 4 | 3 | 1 | AGCAGTGAA | GGGAA | GAGTGAGGC | X | | | |
| 4 | 3 | 1 | AGCTGAGTG | ACAGCT | GAGTGAGGG | X | | | |
| 4 | 3 | 1 | AGCAGTGCG | TGCAT | GAGTGAGGG | X | | | |
| 4 | 3 | 1 | GGCGGGGTC | TGCTC | GAGTGAGGC | X | | | |
| 4 | 3 | 1 | AGAATAGTC | TTAGA | CAGTGAGGA | X | | | |
| 4 | 3 | 1 | AGCAGGGAT | TTGCA | GAGTGAGGC | X | | | |
| 4 | 3 | 1 | GGAAGTGTC | CAAGG | GAGTGAGGT | X | | | |
| 4 | 3 | 1 | ATCAATGTC | CTCTGT | GAGTGAGGG | X | | | |
| 4 | 3 | 1 | CCCAGCTTC | CTGGG | GAGTGAGGC | X | | | |
| 4 | 3 | 1 | AGGTGCGGC | AGGTA | GAGTGAGGG | X | | | |
| 4 | 3 | 1 | AGCTGAGAC | TTAGA | GAGTGAGGT | X | | | |
| 4 | 3 | 1 | AGCAACATG | GCTCA | GAGTGAGGG | X | | | |
| 4 | 3 | 1 | TGCGCCGTC | TACTAG | GAGTGAGGC | X | | | |
| 4 | 3 | 1 | AGCAAAGTT | TAACAA | GAGTGAGAA | X | | | |
| 4 | 3 | 1 | AGCAAAGTT | TAACAA | GAGTGAGAA | X | | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 4 | 3 | 1 | AGCAAAGTT | TAACAA | GAGTGAGAA | X | | | |
| 4 | 3 | 1 | AGCAAAGTT | TAACAA | GAGTGAGAA | X | | | |
| 4 | 3 | 1 | AGCAAAGTT | TAACAA | GAGTGAGAA | X | | | |
| 4 | 3 | 1 | AGTATCATC | CGGCT | GAGTGAGGT | X | | | |
| 4 | 3 | 1 | AGCTGAGAC | TTAGA | GAGTGAGGT | X | | | |
| 4 | 3 | 1 | AGGAGCAAC | CACAGG | GAGTGAGGG | X | | | |
| 4 | 3 | 1 | AGCAGCTCG | CTGAG | GAGTGAGGG | X | | | |
| 4 | 3 | 1 | AGCTGAGAC | TTAGA | GAGTGAGGT | X | | | |
| 4 | 3 | 1 | AGCAATGTG | AGTTGT | GAGTGAGGG | X | | | |
| 4 | 3 | 1 | AGAAGCGGT | GCGTCT | GAGTGAGGT | X | | | |
| 4 | 3 | 1 | AGAAGTGCC | ATCTGT | GAGTGAGGG | X | | | |
| 4 | 4 | 0 | GGATGAGTC | TGGAG | GAGTGAGGA | X | | | |
| 4 | 4 | 0 | ACAGGTGTC | CAAGAT | GAGTGAGGA | X | | | |
| 4 | 4 | 0 | CTGGGCGTC | CCTCCA | GAGTGAGGA | X | | | |
| 4 | 4 | 0 | CCCGGGGTC | TTCAGT | GAGTGAGGA | X | | | |
| 4 | 4 | 0 | TGGCACGTC | TGAGG | GAGTGAGGA | X | | | |
| 4 | 4 | 0 | AGCTCAGTA | CAAAAA | GAGTGAGGA | X | | | |
| 4 | 4 | 0 | AAAAGGTTC | AGAGG | GAGTGAGGA | X | | | |
| 4 | 4 | 0 | GACATCATC | AGAACT | GAGTGAGGA | X | | | |
| 4 | 4 | 0 | AGCACTATT | CTATTA | GAGTGAGGA | X | | | |
| 4 | 4 | 0 | CCCTGAGTC | TGAGG | GAGTGAGGA | X | | | |
| 4 | 4 | 0 | TGGGGAGTC | AGTGC | GAGTGAGGA | X | | | |
| 4 | 4 | 0 | AACAGGGCT | TCTGA | GAGTGAGGA | X | | | |
| 4 | 4 | 0 | AGCAAAGCT | CGAGA | GAGTGAGGA | X | | | |
| 4 | 4 | 0 | AACATTGTT | TCAGT | GAGTGAGGA | X | | | |
| 4 | 4 | 0 | AGACACTTC | ATGAAT | GAGTGAGGA | X | | | |
| 4 | 4 | 0 | GCCCACGTC | TTCGTG | GAGTGAGGA | X | | | |
| 4 | 4 | 0 | AACATGGTT | GTGTGG | GAGTGAGGA | X | | | |
| 4 | 4 | 0 | GGTACAGTC | TTCGCC | GAGTGAGGA | X | | | |
| 4 | 4 | 0 | GGCATGGTG | AGAGTG | GAGTGAGGA | X | | | |
| 4 | 4 | 0 | GGAAGTCTC | AGGAT | GAGTGAGGA | X | | | |
| 4 | 4 | 0 | ATCTTGGTC | AGGGCA | GAGTGAGGA | X | | | |
| 4 | 4 | 0 | ATCAGGTCC | CAATT | GAGTGAGGA | X | | | |
| 4 | 4 | 0 | GGCATGGTG | TAAAGA | GAGTGAGGA | X | | | |
| 4 | 4 | 0 | TGAAACGTT | GCAGG | GAGTGAGGA | X | | | |
| 4 | 4 | 0 | TGAATCGGC | AACAA | GAGTGAGGA | X | | | |
| 4 | 4 | 0 | ATACACGTC | TCCTG | GAGTGAGGA | X | | | |
| 4 | 4 | 0 | GGGAAGGTC | CTTGG | GAGTGAGGA | X | | | |
| 4 | 4 | 0 | CACTGTGTC | GGGTGA | GAGTGAGGA | X | | | |
| 4 | 4 | 0 | ATCTTTGTC | TTCCT | GAGTGAGGA | X | | | |
| 4 | 4 | 0 | CTGAGGGTC | ATTGG | GAGTGAGGA | X | | | |
| 4 | 4 | 0 | ATGTGAGTC | TTCCTT | GAGTGAGGA | X | | | |
| 4 | 4 | 0 | AAAGTCGTC | AGCTAT | GAGTGAGGA | X | | | |
| 4 | 4 | 0 | AACAATGTT | CGCCT | GAGTGAGGA | X | | | |
| 4 | 4 | 0 | GGGAAGGTC | CTATGG | GAGTGAGGA | X | | | |
| 4 | 4 | 0 | GGATGTGTC | TTCAGG | GAGTGAGGA | X | | | |
| 4 | 4 | 0 | TCCACAGTC | TGGGT | GAGTGAGGA | X | | | |
| 4 | 4 | 0 | AGCAAAGCT | ATATGG | GAGTGAGGA | X | | | |
| 4 | 4 | 0 | CCCTGGGTC | CCAGGG | GAGTGAGGA | X | | | |
| 4 | 4 | 0 | GTGAGGGTC | TCTGGA | GAGTGAGGA | X | | | |
| 4 | 4 | 0 | AGCCAGGTT | GAAAAG | GAGTGAGGA | X | | | |
| 4 | 4 | 0 | AGCATGGCT | TATGG | GAGTGAGGA | X | | | |
| 4 | 4 | 0 | AGCTCAGGC | AGGGG | GAGTGAGGA | X | | | |
| 4 | 4 | 0 | CCCTGGGTC | TGCTG | GAGTGAGGA | X | | | |
| 4 | 4 | 0 | AGCAACAGA | TGAAG | GAGTGAGGA | X | | | |
| 4 | 4 | 0 | AGCATGGCT | GGAATG | GAGTGAGGA | X | | | |
| 4 | 4 | 0 | AGCTAAGTT | CTTGTA | GAGTGAGGA | X | | | |
| 4 | 4 | 0 | AACTTTGTC | CTGAA | GAGTGAGGA | X | | | |
| 4 | 4 | 0 | AACATGGTT | CCTTCT | GAGTGAGGA | X | | | |
| 4 | 4 | 0 | CGCCACGGC | TGGGAG | GAGTGAGGA | X | | | |
| 4 | 4 | 0 | CTCATTGTC | CAGGA | GAGTGAGGA | X | | | |
| 4 | 4 | 0 | CCCTGGGTC | ATGTGA | GAGTGAGGA | X | | | |
| 5 | 1 | 4 | AGCAACGTC | AAAGAT | CACTGATCA | X | | | |
| 5 | 1 | 4 | AGCAGCGGC | GACAGC | AGAGGAGGA | X | | | |
| 5 | 1 | 4 | AGCAGCGGC | AAGTGG | GAGTAGGAT | X | | | |
| 5 | 1 | 4 | AGCAGCGGC | GGCACC | ACGTGCGCA | X | | | |
| 5 | 1 | 4 | AGCACCGTC | AATCAG | GTGCGAGTC | X | | | |
| 5 | 1 | 4 | AGCACCGTC | AAGAGT | CAGTGTTTA | X | | | |
| 5 | 2 | 3 | AGCACAGTC | ACCTCT | GAGTGACAC | X | | | |
| 5 | 2 | 3 | AGCAACGTA | TCGAT | GAGGGTAGA | X | | | |
| 5 | 2 | 3 | AGCATCGGC | AGGCA | GAGTAAGTC | X | | | |
| 5 | 2 | 3 | AACAACGTC | CTGAAC | GTGAGAGAA | X | | | |

| # of mutations | | | | | | | VF2468 concentration | | | |
|---|---|---|---|---|---|---|---|---|---|---|
| T | (−) | (+) | (−) site | spacer | (+) site | | 4 nM | 2 nM | 1 nM | 0.5 nM |
| 5 | 2 | 3 | AGCATAGTC | CGTGTA | GTGAGAGAA | X | | | | |
| 5 | 2 | 3 | AGCATGGTC | TTAATG | GAGTGATAG | X | | | | |
| 5 | 2 | 3 | AGCTGTGTC | TGCCTT | GGGTGATGC | X | | | | |
| 5 | 2 | 3 | AGCAATGTC | ATGTC | CAGTGAGCC | X | | | | |
| 5 | 2 | 3 | AGCATTGTC | CAAGGA | GAGTAAGTG | X | | | | |
| 5 | 2 | 3 | AGCAGCTGC | TCTCAA | GAGTATGGG | X | | | | |
| 5 | 2 | 3 | TGCAGTGTC | TGGAGT | GTGTCAGGC | X | | | | |
| 5 | 2 | 3 | AGCATTGTC | CTCCTC | TGGTGAGGT | X | | | | |
| 5 | 2 | 3 | AGCATTGTC | CCAAAA | GTGAGGGA | X | | | | |
| 5 | 2 | 3 | AGCAATGTC | TACCA | CAGTGAGAC | X | | | | |
| 5 | 2 | 3 | AGCAACGTT | CTTTAT | GTAAGAGGA | X | | | | |
| 5 | 2 | 3 | AGCAACTTC | ACTTAG | GCGTGGGAA | X | | | | |
| 5 | 3 | 2 | AGGCGAGTC | TCTTTA | GTGTGAGGC | X | | | | |
| 5 | 3 | 2 | AGCCACGTT | AGGGGT | AAGTGAGGG | X | | | | |
| 5 | 3 | 2 | AGTATCGTG | ATTGA | AAGTGAGGC | X | | | | |
| 5 | 3 | 2 | AGCAAGGTA | GCTTG | GAGTGAGAC | X | | | | |
| 5 | 3 | 2 | TGCAGCTGC | AAAAG | AAGTGAGGG | X | | | | |
| 5 | 3 | 2 | AGTATCTTC | TGGTGT | GAGTGAGAT | X | | | | |
| 5 | 3 | 2 | TGCAGTTTC | TCAAAG | GAGAGTGGA | X | | | | |
| 5 | 3 | 2 | ATCAGGGGC | CCACTA | GAGTAAGGG | X | | | | |
| 5 | 3 | 2 | AGTTGCTTC | TGCATT | GAGTAACGA | X | | | | |
| 5 | 3 | 2 | AGCTACGTG | CCCGGC | CAGTGAGGG | X | | | | |
| 5 | 3 | 2 | AGCTTAGTC | TGAGT | GTGTGAGGT | X | | | | |
| 5 | 3 | 2 | ATCAGGGGC | TGAAG | GAGTAAGGG | X | | | | |
| 5 | 3 | 2 | ATCAGGGGC | TGAAG | GAGTAAGGG | X | | | | |
| 5 | 3 | 2 | AGCAACCCC | TCTGCT | GAGGGAGGC | X | | | | |
| 5 | 3 | 2 | AGCATGGTA | TGATGT | AAGTGAGGG | X | | | | |
| 5 | 3 | 2 | CATAGCGTC | AGATTG | GAGTAAGGT | X | | | | |
| 5 | 3 | 2 | TGCAGCTGC | TGTCAG | AAGTGAGGG | X | | | | |
| 5 | 3 | 2 | AGCTAGGTC | CCCTG | CAGTGAGGG | X | | | | |
| 5 | 3 | 2 | AGCTTGGTC | AGTGAA | GAGAGAGGT | X | | | | |
| 5 | 3 | 2 | AGCAACTAC | ATATCT | GTGTGAGGC | X | | | | |
| 5 | 3 | 2 | AGCAACCCC | TCTGCT | GAGGGAGGC | X | | | | |
| 5 | 3 | 2 | GTCAGTGTC | CTGGAA | AAGTGAGGG | X | | | | |
| 5 | 3 | 2 | TGCAGTGTA | GCTGGA | GAGGGAGGT | X | | | | |
| 5 | 3 | 2 | CTCATCGTC | CAGGCT | GAGTGAGTC | X | | | | |

| # of mutations | | | | | | | VF2468 concentration | | | |
|---|---|---|---|---|---|---|---|---|---|---|
| T | (−) | (+) | (−) site | spacer | (+) site | | 4 nM | 2 nM | 1 nM | 0.5 nM |
| 5 | 3 | 2 | AGTAACATC | AAGTCA | TAGTGAGGC | X | | | | |
| 5 | 3 | 2 | AGCTATGTC | CTAAAG | AAGTGAGGG | X | | | | |
| 5 | 3 | 2 | GTCCGCGTC | TTGTTT | GAGTAAGGG | X | | | | |
| 5 | 3 | 2 | AGCCTTGTC | ACTGA | AAGTGAGGC | X | | | | |
| 5 | 3 | 2 | AGCACAGCC | ACATCT | GTGTGAGGC | X | | | | |
| 5 | 3 | 2 | AGCAACATT | CTAAGC | GAGTGAGTC | X | | | | |
| 5 | 4 | 1 | AGTGTGGTC | GGAGCA | GAGTGAGGG | X | | | | |
| 5 | 4 | 1 | ACTAATGTC | ATGCTA | GAGTGAGGT | X | | | | |
| 5 | 4 | 1 | TACATTGTC | TAGGAG | GAGTGAGGG | X | | | | |
| 5 | 4 | 1 | ATCAATGGC | CAGAT | GAGTGAGGG | X | | | | |
| 5 | 4 | 1 | CGGGGAGTC | CCAGGG | GAGTGAGGG | X | | | | |
| 5 | 4 | 1 | AGCAGGTCA | CATCG | GAGTGAGGG | X | | | | |
| 5 | 4 | 1 | AGCTAGGTT | GGCCC | GAGTGAGGC | X | | | | |
| 5 | 4 | 1 | AGTGTGGTC | AGAGAG | AAGAGAGGA | X | | | | |
| 5 | 4 | 1 | AGTATGGTA | ACAGCA | GAGTGAGGG | X | | | | |
| 5 | 4 | 1 | ATCCGTCTC | TTCTG | GTGTGAGGA | X | | | | |
| 5 | 4 | 1 | AACAGTATT | GCAAT | GAGTGAGGG | X | | | | |
| 5 | 4 | 1 | ATCAGCAGT | GAACA | AAGTGAGGA | X | | | | |
| 5 | 4 | 1 | GGCCAAGTC | AGCGG | GAGTGAGGC | X | | | | |
| 5 | 4 | 1 | GCCAGTGTT | TCTCA | GAGTGAGGT | X | | | | |
| 5 | 4 | 1 | ATCAGGGCA | GGCCAG | GAGTGAGGG | X | | | | |
| 5 | 4 | 1 | AGTAGATGC | AGTTA | GAGTGAGGT | X | | | | |
| 5 | 4 | 1 | GGCCTGGTC | AGGAGG | GAGTGAGGG | X | | | | |
| 5 | 4 | 1 | AGCAACTCA | TTCTGT | GAGTGAGGG | X | | | | |
| 5 | 4 | 1 | GGGGGAGTC | TTGCGG | GAGTGAGGT | X | | | | |
| 5 | 4 | 1 | ATCAGTCTA | GCAGCA | GAGTGAGGC | X | | | | |
| 5 | 4 | 1 | AGTAGATGC | ATAGG | GAGTGAGGT | X | | | | |
| 5 | 4 | 1 | ACCAGTGGT | GGGGT | GAGTGAGGT | X | | | | |
| 5 | 4 | 1 | GGCCTTGTC | CCCTA | GAGTGAGGG | X | | | | |
| 5 | 4 | 1 | CTCATTGTC | TTGCTG | GAGTGAGGC | X | | | | |
| 5 | 4 | 1 | AGTATGGTA | AAAGGA | GAGTGAGGG | X | | | | |
| 5 | 4 | 1 | AGAGAGGTC | AGGGTA | GAGTGAGGG | X | | | | |
| 5 | 4 | 1 | GGCCTGGTC | AGATTT | GAGTGAGGG | X | | | | |
| 5 | 4 | 1 | TGTTGAGTC | CGTATG | GAGTGAGGG | X | | | | |
| 5 | 4 | 1 | AGCACCACT | GACAG | GAGTGAGGG | X | | | | |
| 5 | 4 | 1 | AAAACAGTC | ATCCT | GAGTGAGGG | X | | | | |

| # of mutations | | | | | | | VF2468 concentration | | | |
|---|---|---|---|---|---|---|---|---|---|---|
| T | (−) | (+) | (−) site | spacer | (+) site | 4 nM | 2 nM | 1 nM | 0.5 nM |
| 5 | 4 | 1 | AACAGTATT | AAGGA | GAGTGAGGG | X | | | |
| 5 | 4 | 1 | GCCAACATC | CACAT | GAGTGAGGT | X | | | |
| 5 | 4 | 1 | GGCCAAGTC | TCTCA | GAGTGAGGC | X | | | |
| 5 | 4 | 1 | AAAACAGTC | TTTCGA | GAGTGAGGG | X | | | |
| 5 | 4 | 1 | AATCCCGTC | ATGGA | GAGTGAGGT | X | | | |
| 6 | 4 | 2 | GGTTACGTC | CGGAA | AAGTGAGGC | X | | | |
| 6 | 4 | 2 | AGTTACTTC | TATAA | AAGTGAGGG | X | | | |
| 6 | 4 | 2 | AGTTACTTC | CCTCA | AAGTGAGGG | X | | | |
| 3 | 2 | 1 | GGCATCGTC | CACTC | CAGTGAGGA | X | X | | |
| 4 | 2 | 2 | ATCAGGGTC | CAGCT | CAGTGAGGC | X | X | | |
| 4 | 3 | 1 | AGCTCAGTC | ACTCCT | GAGTGAGGG | X | X | | |
| 4 | 3 | 1 | AGCTCAGTC | CTGGG | GAGTGAGGG | X | X | | |
| 4 | 3 | 1 | AGCATGGTT | TTCTG | GAGTGAGGC | X | X | | |
| 4 | 3 | 1 | AGATGGGTC | TTGCT | GAGTGAGGC | X | | X | |
| 4 | 3 | 1 | AGATGGGTC | TTGCT | GAGTGAGGC | X | | X | |
| 2 | 1 | 1 | AGCAGAGTC | AGGAT | GAATGAGGA | X | | | |
| 2 | 1 | 1 | AGCAGAGTC | ATGAA | GATTGAGGA | X | | | |
| 3 | 0 | 3 | AGCAGCGTC | TGAAAG | TAGAGATGA | X | | | |
| 3 | 0 | 3 | AGCAGCGTC | AGCTTC | AAGTATGGA | X | | | |
| 3 | 0 | 3 | AGCAGCGTC | AACATT | TAGTAATGA | X | | | |
| 3 | 0 | 3 | AGCAGCGTC | AACATT | TAGTAATGA | X | | | |
| 3 | 1 | 2 | AGCAGTGTC | TTAGGA | AAGAGAGGA | X | | | |
| 3 | 1 | 2 | AGCAGCTTC | AGATGG | GAGAGAGAA | X | | | |
| 3 | 1 | 2 | AGCAGTGTC | CAGCA | AAGAGAGGA | X | | | |
| 3 | 1 | 2 | TGCAGCGTC | AATGT | GAGTGAAAA | X | | | |
| 3 | 1 | 2 | AGCAGTGTC | AGGTAT | GAGAGGGA | X | | | |
| 3 | 1 | 2 | AGCAGCTTC | AGGGA | GAGTGTGGG | X | | | |
| 3 | 1 | 2 | AGCAGTGTC | CTTGCC | GAAGGAGGA | X | | | |
| 3 | 1 | 2 | AGCAGCTTC | ATGAAG | GAGAGAGAA | X | | | |
| 3 | 1 | 2 | AGCAGCGTG | GAGGT | GAGTGGGGT | X | | | |
| 3 | 1 | 2 | AGCAGCGTT | ACTCAG | GAGAGAGAA | X | | | |
| 3 | 1 | 2 | AGAAGCGTC | ACTGA | GAGTGAGTT | X | | | |
| 3 | 1 | 2 | AGCAGCATC | TTGAG | GGGTGAGGC | X | | | |
| 3 | 1 | 2 | AGCAGCGGC | ACAAA | GAGGGACGA | X | | | |
| 3 | 1 | 2 | AGCATCGTC | TGAAG | GGGTGAGCA | X | | | |
| 3 | 1 | 2 | AGCAGCTTC | CACCA | GAGGGAGTA | X | | | |
| 3 | 1 | 2 | AGCAGCGTT | CTGTCT | AAGTGAAGA | X | | | |
| 3 | 1 | 2 | AGCAGCATC | TGCTTC | GGGTGAGGC | X | | | |
| 3 | 1 | 2 | AGCAGGGTC | GGGGA | GGGTGAGAA | X | | | |
| 3 | 1 | 2 | AGCAGGGTC | AGCTGG | GAGTAAGAA | X | | | |
| 3 | 1 | 2 | AGCAGCGCC | GGAAGA | GAGCGAGGG | X | | | |
| 3 | 1 | 2 | AGCACCGTC | CCTAA | GACTGAGCA | X | | | |
| 3 | 1 | 2 | AGCAGAGTC | ACAGCT | GAATGAGGC | X | | | |
| 3 | 1 | 2 | AGCAGCGTG | GACCCA | AAGAGAGGA | X | | | |
| 3 | 1 | 2 | AGCAGGGTC | CACAT | GAGTCAGGG | X | | | |
| 3 | 1 | 2 | AGCAGGGTC | GGGGTG | GAGGGAGAA | X | | | |
| 3 | 1 | 2 | GGCAGGGTC | CAGGTA | GACTGAGGG | X | | | |
| 3 | 1 | 2 | AGCAGTGTC | CTAAAG | GAAGGAGGA | X | | | |
| 3 | 1 | 2 | AGCAGCCTC | TTCTG | TAATGAGGA | X | | | |
| 3 | 1 | 2 | AGCAGCGTT | GGGAA | GAGAGAGAA | X | | | |
| 3 | 1 | 2 | AGCAGCGAC | AGGGCA | GAATGAGGC | X | | | |
| 3 | 1 | 2 | AGCAGAGTC | GAGCA | AGGTGAGGA | X | | | |
| 3 | 1 | 2 | AGCAGCATC | GAGTGG | AAGTGGGGA | X | | | |
| 3 | 2 | 1 | AGCTGAGTC | CAGAA | GAGTGGGGA | X | | | |
| 3 | 2 | 1 | GGCAGTGTC | AGTAG | GTGTGAGGA | X | | | |
| 3 | 2 | 1 | AGCAACTTC | AGAAT | GAGTTAGGA | X | | | |
| 3 | 2 | 1 | AGCATCTTC | AGCTA | TAGTGAGGA | X | | | |
| 3 | 2 | 1 | GGCAGGTC | ACCCGA | AAGTGAGGA | X | | | |
| 3 | 2 | 1 | AGCAGTGTG | TGCCCA | GAGTGAGTA | X | | | |
| 3 | 2 | 1 | AGCAGTGTA | CCATGC | GAGTGAGCA | X | | | |
| 3 | 2 | 1 | AGCTGGGTC | TATTTG | GAGTCAGGA | X | | | |
| 3 | 2 | 1 | AGCAGCGAG | GTGGG | GAGTGAGTA | X | | | |
| 3 | 2 | 1 | AGCAGCTTG | GATTCA | GAGTGAGAA | X | | | |
| 3 | 2 | 1 | AGCAGCAGC | AACGAG | GAGCGAGGA | X | | | |
| 3 | 2 | 1 | AGCACCATC | TTTGAA | AAGTGAGGA | X | | | |
| 3 | 2 | 1 | AGCAGAGTT | TGAATT | GAGTTAGGA | X | | | |
| 3 | 2 | 1 | GGCAGGGTC | AAGGA | AAGTGAGGA | X | | | |
| 3 | 2 | 1 | GGCAGTGTC | CAGGAG | GTGTGAGGA | X | | | |
| 3 | 2 | 1 | TGCAACGTC | ACAAGT | GAGAGAGGA | X | | | |
| 3 | 2 | 1 | AACAGTGTC | TTTCAA | AAGTGAGGA | X | | | |
| 3 | 2 | 1 | AGCAGTGTA | GACCCA | GAGTGAGCA | X | | | |
| 3 | 2 | 1 | AGCTGTGTC | CCCTT | GAGAGAGGA | X | | | |

| # of mutations | | | | | | | VF2468 concentration | | | |
|---|---|---|---|---|---|---|---|---|---|---|
| T | (−) | (+) | (−) site | spacer | (+) site | | 4 nM | 2 nM | 1 nM | 0.5 nM |
| 3 | 2 | 1 | AGCAGCGGA | GGTGGG | GAGGGAGGA | | X | | | |
| 3 | 2 | 1 | AACAGCTTC | TCATT | GAGTGAGTA | | X | | | |
| 3 | 2 | 1 | AGTAGAGTC | AGGCCT | GAATGAGGA | | X | | | |
| 3 | 2 | 1 | AGCAGCGAA | GCCGG | AAGTGAGGA | | X | | | |
| 3 | 2 | 1 | AACTGCGTC | CCAGG | AAGTGAGGA | | X | | | |
| 3 | 2 | 1 | AGAAGCCTC | TGCTAT | GAGTGAGGC | | X | | | |
| 3 | 2 | 1 | AGCAGTGTG | CAATG | GAGTGAGTA | | X | | | |
| 3 | 2 | 1 | AGTAGAGTC | CCTGG | GAGTGAGCA | | X | | | |
| 3 | 2 | 1 | GGCAGTGTC | ATGTGT | GAGGGAGGA | | X | | | |
| 3 | 2 | 1 | AGCACTGTC | ACTGTT | GAGTGATGA | | X | | | |
| 3 | 2 | 1 | AGCTGGGTC | TGGGAG | GAGTCAGGA | | X | | | |
| 3 | 2 | 1 | AGCAGCTTT | CCAAGA | GAGTGAGAA | | X | | | |
| 3 | 2 | 1 | AGCAGTGTA | GACCCA | GAGTGAGCA | | X | | | |
| 3 | 2 | 1 | GGCAGCGTG | GGGATG | CAGTGAGGA | | X | | | |
| 3 | 2 | 1 | AGCAGCAGC | AGAGG | GAGCGAGGA | | X | | | |
| 3 | 2 | 1 | AGTAGCTTC | CCTCT | GTGTGAGGA | | X | | | |
| 3 | 2 | 1 | TGCGGCGTC | TCCTGG | GAGTGAAGA | | X | | | |
| 3 | 2 | 1 | AACAGAGTC | TGGCA | GAGTGAGCA | | X | | | |
| 3 | 2 | 1 | GGCAGCGGC | CTGGG | GAGTGTGGA | | X | | | |
| 3 | 2 | 1 | AGCAGGCTC | CTTGT | TAGTGAGGA | | X | | | |
| 3 | 3 | 0 | ATCACCATC | ATACCT | GAGTGAGGA | | X | | | |
| 3 | 3 | 0 | AGCAGTTTA | ATTCT | GAGTGAGGA | | X | | | |
| 3 | 3 | 0 | AACAGCAAC | AAAAA | GAGTGAGGA | | X | | | |
| 3 | 3 | 0 | AGCTGAGTA | GAATG | GAGTGAGGA | | X | | | |
| 3 | 3 | 0 | AGCAACCTG | GGGCT | GAGTGAGGA | | X | | | |
| 3 | 3 | 0 | AGCAACCTG | GAAAA | GAGTGAGGA | | X | | | |
| 3 | 3 | 0 | TGCAGGCTC | CTGTG | GAGTGAGGA | | X | | | |
| 3 | 3 | 0 | CGCAGTATC | CCACT | GAGTGAGGA | | X | | | |
| 3 | 3 | 0 | AGAAACATC | AGATG | GAGTGAGGA | | X | | | |
| 3 | 3 | 0 | ACCTGTGTC | TCCTG | GAGTGAGGA | | X | | | |
| 3 | 3 | 0 | GGCAGGGCC | TCAAGG | GAGTGAGGA | | X | | | |
| 3 | 3 | 0 | AGAAACATC | TAAGAG | GAGTGAGGA | | X | | | |
| 3 | 3 | 0 | AGGTGCATC | CCTCA | GAGTGAGGA | | X | | | |
| 3 | 3 | 0 | GGCAGGGCC | TTCTT | GAGTGAGGA | | X | | | |
| 3 | 3 | 0 | GGCAGCTGC | TTTTT | GAGTGAGGA | | X | | | |
| 3 | 3 | 0 | AGCATGGCC | CAGGAG | GAGTGAGGA | | X | | | |

| # of mutations | | | | | | | VF2468 concentration | | | |
|---|---|---|---|---|---|---|---|---|---|---|
| T | (−) | (+) | (−) site | spacer | (+) site | | 4 nM | 2 nM | 1 nM | 0.5 nM |
| 4 | 0 | 4 | AGCAGCGTC | TTCAGC | AAGTGGAGG | | X | | | |
| 4 | 0 | 4 | AGCAGCGTC | TGGGGC | AGTGGAGGA | | X | | | |
| 4 | 0 | 4 | AGCAGCGTC | TCATA | GAGTTAACC | | X | | | |
| 4 | 0 | 4 | AGCAGCGTC | CCTGA | AATTGTGCA | | X | | | |
| 4 | 1 | 3 | AGCAACGTC | AGGGAA | GAGGGACCA | | X | | | |
| 4 | 1 | 3 | AGCAGGGTC | CACTCA | GAGGGAGTC | | X | | | |
| 4 | 1 | 3 | AGCAGCGTG | TGGCT | GTGTGTGGC | | X | | | |
| 4 | 1 | 3 | AGCAGCGTT | GGCTGA | AACTGAGGT | | X | | | |
| 4 | 1 | 3 | AGCAACGTC | TCCAGG | GACTGAAGC | | X | | | |
| 4 | 1 | 3 | AGCAGGGTC | ATTTAG | GAGTGACAT | | X | | | |
| 4 | 1 | 3 | AGCAGTGTC | TTGTCA | GAGTGTGTC | | X | | | |
| 4 | 1 | 3 | AGCAACGTC | CTCAAG | GAGGCAAGA | | X | | | |
| 4 | 1 | 3 | AGCATCGTC | CACCTG | GCGAGAGGC | | X | | | |
| 4 | 1 | 3 | AGCAGCTTC | TAACA | AAGTGAGAC | | X | | | |
| 4 | 1 | 3 | AGCAACGTC | AGGGAG | GAGAGGGCA | | X | | | |
| 4 | 1 | 3 | AGCAGCGTT | TTCAT | GTGTGTGTA | | X | | | |
| 4 | 1 | 3 | AGCAGCGTT | TAACT | GAGTGAAAG | | X | | | |
| 4 | 1 | 3 | AGCAGGGTC | AGCAG | GAGGGAGTC | | X | | | |
| 4 | 1 | 3 | AGCAGTGTC | ATTAC | GAGTGCGAC | | X | | | |
| 4 | 1 | 3 | AGCAGTGTC | AGTGC | AAGTGCGGG | | X | | | |
| 4 | 1 | 3 | AGCAGCTTC | CATCG | TGGTGTGGA | | X | | | |
| 4 | 1 | 3 | GGCAGCGTC | TAGGG | GTGTGATAA | | X | | | |
| 4 | 1 | 3 | AGCAGCTTC | CGGTC | GAGTGATTT | | X | | | |
| 4 | 1 | 3 | AGCAGGGTC | CGGCTT | GTGTGCGGC | | X | | | |
| 4 | 1 | 3 | AGCAGCGGC | AAGAA | GAGGGTGGT | | X | | | |
| 4 | 1 | 3 | AGCAGCCTC | ACTCA | GAGTGGGAC | | X | | | |
| 4 | 1 | 3 | AGCAACGTC | TCCACA | GAGACAGGC | | X | | | |
| 4 | 1 | 3 | AGCAGCGTG | GGGGA | GTGTGGGGG | | X | | | |
| 4 | 1 | 3 | AGCAGGGTC | TGCAGG | GACTGAGAG | | X | | | |
| 4 | 1 | 3 | AGCAGTGTC | TTTTC | CAGTAAGGT | | X | | | |
| 4 | 1 | 3 | AGCAGCGGC | AAGCAC | AAGCAAGGA | | X | | | |
| 4 | 1 | 3 | AGCAGCTTC | CTCCAG | GGAGAGGT | | X | | | |
| 4 | 1 | 3 | AGCAGCTTC | GCCTGC | TGGTGTGGA | | X | | | |
| 4 | 1 | 3 | AGCAGCGAC | TCACAC | AAGTGAGAT | | X | | | |
| 4 | 1 | 3 | AGCAGCGGC | CCCAGC | GAGTGTGTC | | X | | | |
| 4 | 1 | 3 | AGCAGTGTC | TGCAAC | TAGTGAGCT | | X | | | |

-continued

| # of mutations | | | | | | | VF2468 concentration | | | |
|---|---|---|---|---|---|---|---|---|---|---|
| T | (−) | (+) | (−) site | spacer | (+) site | 4 nM | 2 nM | 1 nM | 0.5 nM |
| 4 | 1 | 3 | AGCAGCGGC | CTGGGG | ACGAGAGGA | | X | | |
| 4 | 1 | 3 | AGCAGCGGC | TGCCA | GAGGGTGGT | | X | | |
| 4 | 1 | 3 | AGCAACGTC | CATTCT | GAGGCAAGA | | X | | |
| 4 | 2 | 2 | AGCATTGTC | GGATTC | TGGTGAGGA | | X | | |
| 4 | 2 | 2 | AGCATGGTC | ACAAA | GGGTGAGGT | | X | | |
| 4 | 2 | 2 | AGCAACATC | ACAGA | GAGAGAGGG | | X | | |
| 4 | 2 | 2 | AGCAATGTC | CCTTG | GAGTGTGGG | | X | | |
| 4 | 2 | 2 | AGCAGCTGC | CAGAG | GAGGGAGGC | | X | | |
| 4 | 2 | 2 | AGCTGGGTC | CTAGA | AAGTGAGGT | | X | | |
| 4 | 2 | 2 | AGCAGCTGC | AGTGA | GAGTGAGCT | | X | | |
| 4 | 2 | 2 | AGCATTGTC | AATGA | CAGTGAGAA | | X | | |
| 4 | 2 | 2 | AGCAAAGTC | TAAGA | GAGTGTGGC | | X | | |
| 4 | 2 | 2 | AGCAGGGTG | GAGAA | GAGCGAGGG | | X | | |
| 4 | 2 | 2 | ATCAACGTC | CTTTGA | GAGAAAGGA | | X | | |
| 4 | 2 | 2 | AGCAGCTTT | TTTCC | GAGTGAGAG | | X | | |
| 4 | 2 | 2 | GGCAGCGTT | TCCTGT | GAGCAAGGA | | X | | |
| 4 | 2 | 2 | AGCACCATC | AGGAG | GAGGGAGGG | | X | | |
| 4 | 2 | 2 | ATCAGAGTC | TGCAG | GCGTGAGGC | | X | | |
| 4 | 2 | 2 | AGCACCGGC | CTCTTG | GAGGGAGGT | | X | | |
| 4 | 2 | 2 | GGCAGGGTC | AGTGG | GAGTGAGTC | | X | | |
| 4 | 2 | 2 | AGCACCTTC | TCCTGG | TAGTGAGGC | | X | | |
| 4 | 2 | 2 | AGCGGTGTC | ATCCAG | GAGTGAGCG | | X | | |
| 4 | 2 | 2 | AGCAATGTC | TATAA | AAGTGAGGC | | X | | |
| 4 | 2 | 2 | AGCAGGGTA | AGTAC | AAGTGAGGC | | X | | |
| 4 | 2 | 2 | AGCAACGTG | ATCGG | GAGGGAGGG | | X | | |
| 4 | 2 | 2 | AGCAGGGTA | GATGG | GAGAGAGGG | | X | | |
| 4 | 2 | 2 | AGCAATGTC | TGGGT | GAGTGTGGG | | X | | |
| 4 | 2 | 2 | AGCAATGTC | TGAAA | TAGTGAGTA | | X | | |
| 4 | 2 | 2 | TGCAGAGTC | AAGGAA | GAGTGAGAT | | X | | |
| 4 | 2 | 2 | AGCATAGTC | TCCTAG | GAGAGAGGC | | X | | |
| 4 | 2 | 2 | AGCAGGGTA | ATGGG | GAGAGAGGG | | X | | |
| 4 | 2 | 2 | ATCACCGTC | GAGGG | GAGGGAGGG | | X | | |
| 4 | 2 | 2 | GGCAGCTTC | GGTGTC | CAGTGAGGC | | X | | |
| 4 | 2 | 2 | AGCTGGGTC | TCATTG | CAGTGAGGT | | X | | |
| 4 | 2 | 2 | AGCAACGTA | CTGTT | AAGTGAGAA | | X | | |
| 4 | 2 | 2 | AGCAAAGTC | AAGAA | GAGTGAAAA | | X | | |
| 4 | 2 | 2 | GGCAGGGTC | TCTCA | AAGTGAGGT | | X | | |
| 4 | 2 | 2 | TGCAGGGTC | ATGCAA | GTGTGAGGT | | X | | |
| 4 | 2 | 2 | AGCAAAGTC | AGAGCT | GAGTGAGCC | | X | | |
| 4 | 2 | 2 | GGCAGTGTC | ATTTTT | GAGTAAGGG | | X | | |
| 4 | 2 | 2 | AGCAGCTGC | TGTGG | GAGGGAGGC | | X | | |
| 4 | 2 | 2 | AGCAGCGGT | GGTATC | TAGTGAGGC | | X | | |
| 4 | 2 | 2 | AGCAACATC | TGGAAC | GAGTGAATA | | X | | |
| 4 | 2 | 2 | AGCAGTGTG | ATCTT | GAGTAAGGC | | X | | |
| 4 | 2 | 2 | GGCAGCTTC | AGCAC | CAGTGAGGC | | X | | |
| 4 | 2 | 2 | AGCAGAGTT | GCTTAA | GAGTGAGAG | | X | | |
| 4 | 2 | 2 | AGCACCTTC | TGCCAA | GAGTGAGAT | | X | | |
| 4 | 2 | 2 | AGCAGCTGC | GGGCA | GAGTGAGGT | | X | | |
| 4 | 2 | 2 | AGTAGAGTC | TTTGTT | GTGTGAGGT | | X | | |
| 4 | 2 | 2 | AGCATGGTC | GTTGGG | GGGTGAGGC | | X | | |
| 4 | 2 | 2 | AGCATTGTC | TCTTGT | GTGTGAGGT | | X | | |
| 4 | 2 | 2 | ATCAGAGTC | AATTTG | TAGTGAGGT | | X | | |
| 4 | 2 | 2 | AGCAGCTTA | GAGGG | GAGAGAGGT | | X | | |
| 4 | 2 | 2 | GACAGCGTC | CTCCG | GGGTGAGGC | | X | | |
| 4 | 2 | 2 | TGCAGAGTC | AGCCCT | GAGTGAGAT | | X | | |
| 4 | 2 | 2 | AGCAGAGTT | GGAAG | GAGTGAGAG | | X | | |
| 4 | 2 | 2 | AGCAGGGTA | GGTCA | GAGAGAGGG | | X | | |
| 4 | 3 | 1 | TGCAGTGAC | TGTCCA | GAGTGAGGC | | X | | |
| 4 | 3 | 1 | AGCAGAGGT | GAGGT | GAGTGAGGG | | X | | |
| 4 | 3 | 1 | AGCAGTTTA | AATTT | GAGTGAGGC | | X | | |
| 4 | 3 | 1 | AGAAAGGTC | ATAAT | GAGTGAGGG | | X | | |
| 4 | 3 | 1 | AGCACAATC | CCAAAG | GAGTGAGGC | | X | | |
| 4 | 3 | 1 | AGCAAAGGC | AGGAG | GAGTGAGGT | | X | | |
| 4 | 3 | 1 | AGCCACATC | CCCTA | GAGTGAGGT | | X | | |
| 4 | 3 | 1 | TGCTGGGTC | TACAG | GAGTGAGGC | | X | | |
| 4 | 3 | 1 | GGCAGTGTG | AGCTG | GAGTGAGGG | | X | | |
| 4 | 3 | 1 | AGTAGTGTG | CTGAA | GAGTGAGGG | | X | | |
| 4 | 3 | 1 | TGCATGGTC | AGAGGT | GAGTGAGGG | | X | | |
| 4 | 3 | 1 | AGCATAGTT | TAGGAT | CAGTGAGGA | | X | | |
| 4 | 3 | 1 | AGCAGCAGG | ATGAGA | GAGTGAGGC | | X | | |
| 4 | 3 | 1 | AGCACCATT | AAATTG | GAGTGAGGC | | X | | |
| 4 | 3 | 1 | ATCAGGGTT | AAGCA | GAGTGAGGG | | X | | |

| # of mutations | | | | | | VF2468 concentration | | | |
|---|---|---|---|---|---|---|---|---|---|
| T | (-) | (+) | (-) site | spacer | (+) site | 4 nM | 2 nM | 1 nM | 0.5 nM |
| 4 | 3 | 1 | AGCAAAGTG | GAGAG | GAGGGAGGA | | X | | |
| 4 | 3 | 1 | AGCAACACC | AATGAA | GAGTGAAGA | | X | | |
| 4 | 3 | 1 | GGCAGTGGC | TCTGT | GAGTGAGGT | | X | | |
| 4 | 3 | 1 | AGTATCGGC | TGTGGT | GAGTGAGGG | | X | | |
| 4 | 3 | 1 | GGCAGCTCC | GCCTCC | GAGTGAGGG | | X | | |
| 4 | 3 | 1 | AGCAAAGGC | TGGGTG | GAGTGAGGT | | X | | |
| 4 | 3 | 1 | AGCAAGTTC | CACTG | GAGTGTGGA | | X | | |
| 4 | 3 | 1 | AGCAAAGGC | AGTCA | GAGTGAGGG | | X | | |
| 4 | 3 | 1 | CGCAGCAAC | GCTCTG | GAGTGAGGC | | X | | |
| 4 | 3 | 1 | GGCAGCGGT | TGGGG | GAGTGAGGC | | X | | |
| 4 | 3 | 1 | AGCAACTGC | TTTTA | GAGTGAGCA | | X | | |
| 4 | 3 | 1 | AGAAGAGTA | AAGCA | GAGTGAGGT | | X | | |
| 4 | 3 | 1 | AGCAACATA | ATAACA | GAGTGAGGT | | X | | |
| 4 | 3 | 1 | CGCACCTTC | CTGTAT | GAGTGAGGC | | X | | |
| 4 | 3 | 1 | GTCCGCGTC | GCCCA | GAGTGAGAA | | X | | |
| 4 | 3 | 1 | GGCAGTGTG | CTTGAT | GAGTGAGGG | | X | | |
| 4 | 3 | 1 | CCCACCGTC | CTAAAG | AAGTGAGGA | | X | | |
| 4 | 3 | 1 | AACAACGTG | AAACCA | GAGTGAGGC | | X | | |
| 4 | 3 | 1 | AGCAACCAC | AAAAA | AAGTGAGGA | | X | | |
| 4 | 3 | 1 | AGCCCCTTC | AGCATA | GAGTGAGGG | | X | | |
| 4 | 3 | 1 | AGCCGCTGC | AGCAGG | GAGTGAGGT | | X | | |
| 4 | 3 | 1 | AGCCGCTGC | AGCAGG | GAGTGAGGT | | X | | |
| 4 | 3 | 1 | AGCCGCTGC | AGCAGG | GAGTGAGGT | | X | | |
| 4 | 3 | 1 | AGCCGCTGC | AGCAGG | GAGTGAGGT | | X | | |
| 4 | 3 | 1 | AGAGGGGTC | TGCAG | GAGTGAGGG | | X | | |
| 4 | 3 | 1 | AGCAAAGGC | AAATA | GAGTGAGGG | | X | | |
| 4 | 3 | 1 | GGCAACTTC | CAAGA | AAGTGAGGA | | X | | |
| 4 | 3 | 1 | GCCAGCTTC | CATACA | GAGTGAGGC | | X | | |
| 4 | 3 | 1 | AGAAGGGTG | ATTAG | GAGTGAGGC | | X | | |
| 4 | 3 | 1 | AGCTACGAC | TCAGGA | GAGTGAGGT | | X | | |
| 4 | 3 | 1 | AGCAAGGTG | GGCGG | GAGTGAGGG | | X | | |
| 4 | 3 | 1 | AGGAGAGTT | AGAAGA | GAGTGAGGT | | X | | |
| 4 | 3 | 1 | TGCTCCGTC | CTGGCT | GAGTGAGGT | | X | | |
| 4 | 3 | 1 | AGCACTGTT | TGCCC | GAGTGAGGC | | X | | |
| 4 | 3 | 1 | AGTACCATC | AGGGCT | GAGTGAGGC | | X | | |
| 4 | 3 | 1 | AGCAGCAGG | GCAGT | GAGTGAGGC | | X | | |
| 4 | 3 | 1 | GGCAGGGAC | CATAT | GAGTGAGGC | | X | | |
| 4 | 3 | 1 | AGCAAGGTT | CCCCG | GAGTGAGTA | | X | | |
| 4 | 3 | 1 | AGCATGGGC | AGGGG | GAGTGAGGC | | X | | |
| 4 | 3 | 1 | AGCTGAGTA | GCTAA | GAGTGAGGC | | X | | |
| 4 | 3 | 1 | AGCGACTTC | ATATCT | GAGTGAGGT | | X | | |
| 4 | 3 | 1 | AGGAGAGTT | TAAAG | GAGTGAGGT | | X | | |
| 4 | 3 | 1 | GACAGCATC | AGTCTG | GAGTGAGGG | | X | | |
| 4 | 3 | 1 | AGCAACTCC | ATTTC | GAGTGAGGC | | X | | |
| 4 | 3 | 1 | AGTCGCTTC | ACTTTG | GAGTGAGAA | | X | | |
| 4 | 3 | 1 | AGTAACATC | TTTACT | GAGGGAGGA | | X | | |
| 4 | 3 | 1 | AGCAACTGC | AATGGT | GAGTGAGCA | | X | | |
| 4 | 3 | 1 | AGCATTGTG | CTAGG | CAGTGAGGA | | X | | |
| 4 | 3 | 1 | AGAAAAGTC | TTGAAG | GAGTGAGGG | | X | | |
| 4 | 3 | 1 | GGCAGTGTA | GGGAG | GAGTGAGGT | | X | | |
| 4 | 3 | 1 | AGCAAGGTA | AAGGAG | GAGTGAGGT | | X | | |
| 4 | 3 | 1 | AGCATCTGC | AGATG | GAGTGAGGC | | X | | |
| 4 | 3 | 1 | TGCATAGTT | TTGGG | GAGTGAGGG | | X | | |
| 4 | 3 | 1 | AGAAGGGTG | AGGTGG | GAGTGAGGC | | X | | |
| 4 | 3 | 1 | AGCCGAGTG | GTTAA | GAGTGAGGG | | X | | |
| 4 | 3 | 1 | CTCAGGGTC | ATTAGT | GAGTGAGGG | | X | | |
| 4 | 3 | 1 | AACAGGGTT | GGCCT | GAGTGAGGC | | X | | |
| 4 | 3 | 1 | AGCCTAGTC | ACACCT | GAGTGAGGG | | X | | |
| 4 | 3 | 1 | AGCAATGTT | TTGCT | GAGTGAGAA | | X | | |
| 4 | 3 | 1 | AGCAGCAAA | TCTGCT | GAGTGAGGT | | X | | |
| 4 | 3 | 1 | AGCAGTCCC | TGCCCA | GAGTGAGGC | | X | | |
| 4 | 3 | 1 | TGCAATGTC | TTTGA | GAGTGAGGT | | X | | |
| 4 | 3 | 1 | TGCAGGTTC | TTTGG | GAGTGAGGG | | X | | |
| 4 | 3 | 1 | AGCTAAGTC | TGTAGG | CAGTGAGGA | | X | | |
| 4 | 3 | 1 | AGCATAGTT | GGGAG | CAGTGAGGA | | X | | |
| 4 | 3 | 1 | AGCATGGTA | GAGACT | GAGTGAGGG | | X | | |
| 4 | 3 | 1 | AGCAAGGAC | TGGGCT | GAGTGAGGC | | X | | |
| 4 | 3 | 1 | AGGTGGGTC | CCCAGA | GAGTGAGGC | | X | | |
| 4 | 3 | 1 | AGCAGCTGT | CAATCA | GAGTGAGGC | | X | | |
| 4 | 3 | 1 | TGCATGGTC | CTGGAG | GAGTGAGGG | | X | | |
| 4 | 3 | 1 | AGCATAGTA | CTTAA | GAGTGAGGG | | X | | |
| 4 | 3 | 1 | AGCAAGGTA | ATTAG | GAGTGAGTA | | X | | |

| # of mutations | | | | | | VF2468 concentration | | | |
|---|---|---|---|---|---|---|---|---|---|
| T | (-) | (+) | (-) site | spacer | (+) site | 4 nM | 2 nM | 1 nM | 0.5 nM |
| 4 | 3 | 1 | TGCACCTTC | ATGCCT | GAGTGAGGG | | X | | |
| 4 | 3 | 1 | AGCACCGAG | GTCGGA | GAGTGAGGG | | X | | |
| 4 | 3 | 1 | TGGAGAGTC | AGCAG | GAGTGAGTA | | X | | |
| 4 | 3 | 1 | AGAAGAGTT | AGGTGG | GAGTGAGGT | | X | | |
| 4 | 3 | 1 | ATCAGGGTT | AGGAT | GAGTGAGGG | | X | | |
| 4 | 3 | 1 | GGCAGTGCC | CAGCAG | GAGTGAGGC | | X | | |
| 4 | 3 | 1 | AGTAAGGTC | TTAAA | TAGTGAGGA | | X | | |
| 4 | 3 | 1 | AGCAGCAGG | CCAGT | GAGTGAGGC | | X | | |
| 4 | 4 | 0 | AGCCATGTG | CAAGT | GAGTGAGGA | | X | | |
| 4 | 4 | 0 | GGTAGTGTT | ATGAAT | GAGTGAGGA | | X | | |
| 4 | 4 | 0 | TACAAAGTC | GATGA | GAGTGAGGA | | X | | |
| 4 | 4 | 0 | AGCCATGTA | CATGT | GAGTGAGGA | | X | | |
| 4 | 4 | 0 | GACTGGGTC | TGTCAT | GAGTGAGGA | | X | | |
| 4 | 4 | 0 | AGCACAGCA | GATGA | GAGTGAGGA | | X | | |
| 4 | 4 | 0 | TGAATAGTC | TTGGAA | GAGTGAGGA | | X | | |
| 4 | 4 | 0 | GTCAGGTTC | ACACAT | GAGTGAGGA | | X | | |
| 4 | 4 | 0 | GGTAAAGTC | TGGTCA | GAGTGAGGA | | X | | |
| 4 | 4 | 0 | AGTATAGTG | GCAGA | GAGTGAGGA | | X | | |
| 4 | 4 | 0 | ATGGGGTC | AGAGGG | GAGTGAGGA | | X | | |
| 4 | 4 | 0 | CCCAAAGTC | GTAAG | GAGTGAGGA | | X | | |
| 4 | 4 | 0 | CAAATCGTC | TACAT | GAGTGAGGA | | X | | |
| 4 | 4 | 0 | AATAAGGTC | ATAGCA | GAGTGAGGA | | X | | |
| 4 | 4 | 0 | AGTATAGTT | CAGAT | GAGTGAGGA | | X | | |
| 4 | 4 | 0 | AGAGAGGTC | AAGGA | GAGTGAGGA | | X | | |
| 4 | 4 | 0 | TGGTGAGTC | ACCAC | GAGTGAGGA | | X | | |
| 4 | 4 | 0 | TGCCTGGTC | ACTTGG | GAGTGAGGA | | X | | |
| 4 | 4 | 0 | AGCCATGTG | GGAAG | GAGTGAGGA | | X | | |
| 4 | 4 | 0 | AACAAGGTT | CGCAGA | GAGTGAGGA | | X | | |
| 4 | 4 | 0 | AGCAATTTA | TGTACA | GAGTGAGGA | | X | | |
| 4 | 4 | 0 | AGGCATGTC | TCAGCA | GAGTGAGGA | | X | | |
| 4 | 4 | 0 | TACAAAGTC | CTTAG | GAGTGAGGA | | X | | |
| 4 | 4 | 0 | AATAAGGTC | AGAGAG | GAGTGAGGA | | X | | |
| 4 | 4 | 0 | AATAAGGTC | AGATAG | GAGTGAGGA | | X | | |
| 4 | 4 | 0 | AATAAGGTC | AAATAG | GAGTGAGGA | | X | | |
| 4 | 4 | 0 | AATAAGGTC | AGATG | GAGTGAGGA | | X | | |
| 4 | 4 | 0 | AATAAGGTC | AGATAG | GAGTGAGGA | | X | | |
| 4 | 4 | 0 | AGCACAGCA | GGCAG | GAGTGAGGA | | X | | |
| 4 | 4 | 0 | GGAAAGGTC | AGTTAT | GAGTGAGGA | | X | | |
| 4 | 4 | 0 | AGCCATTTC | AACAA | GAGTGAGGA | | X | | |
| 4 | 4 | 0 | AATAAGGTC | ACGGTG | GAGTGAGGA | | X | | |
| 4 | 4 | 0 | ATCAGCACT | TCAGA | GAGTGAGGA | | X | | |
| 4 | 4 | 0 | GGTGGGGTC | ATGGA | GAGTGAGGA | | X | | |
| 4 | 4 | 0 | CACACAGTC | AGTGTA | GAGTGAGGA | | X | | |
| 4 | 4 | 0 | AATATTGTC | TCTGT | GAGTGAGGA | | X | | |
| 4 | 4 | 0 | GGAATAGTC | TGGTTA | GAGTGAGGA | | X | | |
| 4 | 4 | 0 | AGCAACAAT | CGTAC | GAGTGAGGA | | X | | |
| 4 | 4 | 0 | AATAAGGTC | ACAGTG | GAGTGAGGA | | X | | |
| 4 | 4 | 0 | GACTGTGTC | CTTCA | GAGTGAGGA | | X | | |
| 4 | 4 | 0 | AATAAGGTC | AGATAG | GAGTGAGGA | | X | | |
| 4 | 4 | 0 | AATAAGGTC | AGAGAG | GAGTGAGGA | | X | | |
| 4 | 4 | 0 | AATAAGGTC | AGACAA | GAGTGAGGA | | X | | |
| 4 | 4 | 0 | AATAAGGTC | AGATAG | GAGTGAGGA | | X | | |
| 4 | 4 | 0 | AATAAGGTC | AGATG | GAGTGAGGA | | X | | |
| 5 | 1 | 4 | AGCAGCTTC | CCCTG | CAGAAAGGT | | X | | |
| 5 | 2 | 3 | GGCAACGTC | ATCTC | TAGTGAGAC | | X | | |
| 5 | 2 | 3 | AGCAGTTTC | TTTTAC | TTGTGAGGG | | X | | |
| 5 | 2 | 3 | AGCAGTTTC | AGTATC | TTGTGAGGG | | X | | |
| 5 | 2 | 3 | AGCAGCAGC | CGAAC | GAGGGAGAT | | X | | |
| 5 | 2 | 3 | AGCAGCAGC | CCAGG | GAGGGAGAT | | X | | |
| 5 | 2 | 3 | AGCAACTTC | TCTAA | TTGTGAGGT | | X | | |
| 5 | 2 | 3 | AGCAACTTC | CACAG | TTGTGAGGT | | X | | |
| 5 | 2 | 3 | AGCAAGGTC | AGTGA | TAGTGAATA | | X | | |
| 5 | 2 | 3 | AGCAGTTTC | GGTGTT | TTGTGAGGG | | X | | |
| 5 | 2 | 3 | AGCAGCAGC | AGGAA | GAGGGAGAT | | X | | |
| 5 | 2 | 3 | AGCATTGTC | TTAGA | AAGTAAGGG | | X | | |
| 5 | 3 | 2 | AGCCCAGTC | TCAGG | GAGTGAGAG | | X | | |
| 5 | 3 | 2 | AGCTACATC | TGCATT | GAGTGAGTC | | X | | |
| 5 | 3 | 2 | AGCATGGTT | TGAAAG | GAGTGAGCC | | X | | |
| 5 | 3 | 2 | GACAGGGTC | CACTTG | GAGTGAGTC | | X | | |
| 5 | 3 | 2 | ATCCTCGTC | CTGCA | GAGTGAGTC | | X | | |
| 5 | 3 | 2 | CAGAGCGTC | CAGGT | GAGTGAGTC | | X | | |

| # of mutations | | | | | | VF2468 concentration | | | |
|---|---|---|---|---|---|---|---|---|---|
| T | (−) | (+) | (−) site | spacer | (+) site | 4 nM | 2 nM | 1 nM | 0.5 nM |
| 5 | 3 | 2 | AGCAAAGGC | CTGAAG | GAGTAAGGG | X | | | |
| 5 | 3 | 2 | AGCATCGAT | TAAAA | GAGTGAGAG | X | | | |
| 5 | 3 | 2 | ATCATGGTC | ACTTT | GAGGGAGGG | X | | | |
| 5 | 3 | 2 | AGCCCAGTC | CCCCTA | GAGTGAGAG | X | | | |
| 5 | 3 | 2 | TGCATAGTC | AATTT | GAGTGAGAT | X | | | |
| 5 | 3 | 2 | AGCCATGTC | AGCTT | GAGGGAGGT | X | | | |
| 5 | 3 | 2 | AGCATTGTA | GGGGAC | GAGTGTGGT | X | | | |
| 5 | 3 | 2 | ATCATGGTC | CAGGA | GAGGGAGGG | X | | | |
| 5 | 3 | 2 | AGCAAAGGC | CAAGT | GAGTAAGGG | X | | | |
| 5 | 3 | 2 | ATAAGAGTC | ATGCAG | GAGTGAGTG | X | | | |
| 5 | 3 | 2 | AGCCATGTC | CCAAGG | GAGGGAGGT | X | | | |
| 5 | 3 | 2 | AGCAAAGGC | AATGA | GAGTAAGGG | X | | | |
| 5 | 3 | 2 | AGCCCAGTC | AGGAT | GAGTGAGAG | X | | | |
| 5 | 4 | 1 | TTCCACGTC | AACAT | GAGTGAGGG | X | | | |
| 5 | 4 | 1 | AGTCAGGTC | CCCACA | GAGTGAGGT | X | | | |
| 5 | 4 | 1 | CTGAGGGTC | GGTAG | GAGTGAGGC | X | | | |
| 5 | 4 | 1 | ATGACAGTC | TATGCA | GAGTGAGGC | X | | | |
| 5 | 4 | 1 | AACAGTCTA | CCTGA | GAGTGAGGC | X | | | |
| 5 | 4 | 1 | CTCAGTTTC | CTGAG | GAGTGAGGG | X | | | |
| 5 | 4 | 1 | AGTCAGGTC | TTCCAT | GAGTGAGGG | X | | | |
| 5 | 4 | 1 | GTGGGCGTC | CACTAA | GAGTGAGGC | X | | | |
| 5 | 4 | 1 | GGTGGGGTC | CTTGAA | GAGTGAGGC | X | | | |
| 5 | 4 | 1 | AGTTAAGTC | TCTAGA | GAGTGAGGG | X | | | |
| 5 | 4 | 1 | TTCACCTTC | CACCAT | GAGTGAGGC | X | | | |
| 5 | 4 | 1 | TCCTGAGTC | TTGGTA | GAGTGAGGC | X | | | |
| 5 | 4 | 1 | ATAATAGTC | TCCAT | GAGTGAGGC | X | | | |
| 5 | 4 | 1 | AGCAAAGGT | GGGGTG | GAGTGAGGT | X | | | |
| 5 | 4 | 1 | AGTTTAGTC | CTTGG | GAGTGAGGT | X | | | |
| 5 | 4 | 1 | ACAAAGGTC | CTCCA | GAGTGAGGC | X | | | |
| 5 | 4 | 1 | TGCAGTCCC | AATCA | GAGTGAGGT | X | | | |
| 5 | 4 | 1 | AGTCATGTC | GTTAA | GAGTGAGGC | X | | | |
| 5 | 4 | 1 | CACCACGTC | AAGGTA | GAGAGAGGA | X | | | |
| 5 | 4 | 1 | CTCAGTTTC | AAAAGC | GAGTGAGGG | X | | | |
| 5 | 4 | 1 | GAAAGTGTC | CAAGTG | GAGTGAGGC | X | | | |
| 5 | 4 | 1 | GGGTGGGTC | TAGAGG | GAGTGAGGT | X | | | |
| 5 | 4 | 1 | AGAGTTGTC | CCCCAA | GAGTGAGGC | X | | | |
| 6 | 4 | 2 | AGAAGGGGT | AGGAG | GAGTGAGAG | X | | | |
| 3 | 1 | 2 | AGCAGAGTC | ATATT | GAGTCAGGG | | X | | |
| 3 | 3 | 0 | ACCATCTTC | ATCAG | GAGTGAGGA | | X | | |
| 4 | 2 | 2 | AGGAACGTC | TCCAA | GGGTGAGGG | | X | | |
| 4 | 2 | 2 | AGCACCTTC | AGAGG | GAGTGTGGC | | X | | |
| 4 | 2 | 2 | GGCAGGGTC | GGTCA | GAGTGAGAG | | X | | |
| 4 | 2 | 2 | GGCAGGGTC | ACAGGT | GAGTGAGAG | | X | | |
| 4 | 2 | 2 | AGCACAGTC | AAGCT | GAGGGAGGT | | X | | |
| 4 | 2 | 2 | GGCAGGGTC | TAGGCA | GAGTGAGAG | | X | | |
| 4 | 2 | 2 | AGCAAGGTC | TACTCG | GGGTGAGGC | | X | | |
| 4 | 3 | 1 | AGCAAGTTC | CGTTAA | GAGTGAGGT | | X | | |
| 4 | 3 | 1 | AGCAGTTTT | TGCAGT | GAGTGAGGC | | X | | |
| 2 | 1 | 1 | AGCTGCGTC | ACATG | GACTGAGGA | | | | X |
| 3 | 1 | 2 | AGCAGGGTC | TGAGCT | GTGTGGGA | | | | X |
| 3 | 1 | 2 | AGCAGGGTC | AGCTG | GTGTGGGA | | | | X |
| 3 | 2 | 1 | AGAAGCCTC | AAGGAT | GAGTGAGGT | | | | X |
| 3 | 2 | 1 | AGAAGCCTC | ATAAGT | GAGTGAGGT | | | | X |
| 3 | 3 | 0 | AGCATTTTC | AATTT | GAGTGAGGA | | | | X |
| 4 | 0 | 4 | AGCAGGGTC | CCTCC | GACACTGGA | | | | X |
| 4 | 1 | 3 | AGCAGTGTC | ACCGAC | AGGTGAGGC | | | | X |
| 4 | 1 | 3 | AGCAGTGTC | TGGGA | GAGGGTAGA | | | | X |
| 4 | 2 | 2 | AGCAACTTC | TTCCT | GGGTGAGGC | | | | X |
| 4 | 3 | 1 | AGCCCGGTC | TGAAAG | GAGTGAAGA | | | | X |
| 4 | 3 | 1 | AGTAACTTC | TGAGTG | GAGTGAGGC | | | | X |
| 4 | 3 | 1 | AGTAACTTC | AAAAT | GAGTGAGGC | | | | X |
| 4 | 3 | 1 | ACCTGCTTC | AAAGT | GAGTGAGGG | | | | X |
| 4 | 3 | 1 | AGCATTTTC | CCCCTA | AGTGAGGA | | | | X |
| 4 | 3 | 1 | AGTAACTTC | AGTATA | GAGTGAGGC | | | | X |
| 4 | 3 | 1 | AGCAATGTT | TGAGT | GAGTGATGA | | | | X |
| 4 | 3 | 1 | AGCATTTTC | CTTTA | AGTGAGGA | | | | X |
| 4 | 3 | 1 | AGCCACGGC | TGCCTG | GAGTGAGGG | | | | X |
| 4 | 4 | 0 | CCTAGAGTC | CAGGA | GAGTGAGGA | | | | X |
| 5 | 4 | 1 | ATCATAGTG | ACCAC | GAGTGAGGC | | | | X |

SEQUENCE LISTING (8766 sequences)

SEQ ID NO: 1 - DNA, 14 bp, Artificial Sequence
  Synthetic oligonucleotide
  misc_feature (1)..(1): n is a, c, g, or t
  misc_feature (14)..(14): n is a, c, g, or t
ngatgaggatgacn

SEQ ID NO: 2 - DNA, 14 bp, Artificial Sequence
  Synthetic oligonucleotide
  misc_feature (1)..(1): n is a, c, g, or t
  misc_feature (14)..(14): n is a, c, g, or t
naaactgcaaaagn

SEQ ID NO: 3 - DNA, 11 bp, Artificial Sequence
  Synthetic oligonucleotide
  misc_feature (1)..(1): n is a, c, g, or t
  misc_feature (11)..(11): n is a, c, g, or t
ngagtgaggan

SEQ ID NO: 4 - DNA, 11 bp, Artificial Sequence
  Synthetic oligonucleotide
  misc_feature (1)..(1): n is a, c, g, or t
  misc_feature (11)..(11): n is a, c, g, or t
ngacggtgctn

SEQ ID NO: 5 - DNA, 12 bp, Artificial Sequence
  Synthetic oligonucleotide
gtcatcctcatc

SEQ ID NO: 6 - DNA, 12 bp, Artificial Sequence
  Synthetic oligonucleotide
aaactgcaaaag

SEQ ID NO: 7 - DNA, 12 bp, Artificial Sequence
  Synthetic oligonucleotide
gatgaggatgac

SEQ ID NO: 8 - DNA, 12 bp, Artificial Sequence
  Synthetic oligonucleotide
gatgaggggcga

SEQ ID NO: 9 - DNA, 12 bp, Artificial Sequence
  Synthetic oligonucleotide
gatgaggcacga

SEQ ID NO: 10 - DNA, 12 bp, Artificial Sequence
  Synthetic oligonucleotide
gctgaggataac

SEQ ID NO: 11 - DNA, 12 bp, Artificial Sequence
  Synthetic oligonucleotide
gatacagatgac

SEQ ID NO: 12 - DNA, 12 bp, Artificial Sequence
  Synthetic oligonucleotide
aaactggaaaag

SEQ ID NO: 13 - DNA, 12 bp, Artificial Sequence
  Synthetic oligonucleotide
aaaatggaacag

SEQ ID NO: 14 - DNA, 12 bp, Artificial Sequence
  Synthetic oligonucleotide
aaactggaaaaa

SEQ ID NO: 15 - DNA, 9 bp, Artificial Sequence
  Synthetic oligonucleotide
gagtgagga

SEQ ID NO: 16 - DNA, 9 bp, Artificial Sequence
  Synthetic oligonucleotide
gagtgaaac

SEQ ID NO: 17 - DNA, 9 bp, Artificial Sequence
  Synthetic oligonucleotide
gagtgagtc

SEQ ID NO: 18 - DNA, 9 bp, Artificial Sequence
  Synthetic oligonucleotide
gtgtgaaaa

SEQ ID NO: 19 - DNA, 9 bp, Artificial Sequence
  Synthetic oligonucleotide
gagtgagga

SEQ ID NO: 20 - DNA, 9 bp, Artificial Sequence
  Synthetic oligonucleotide
gacgctgct

SEQ ID NO: 21 - DNA, 9 bp, Artificial Sequence
  Synthetic oligonucleotide
gacgttgct

SEQ ID NO: 22 - DNA, 9 bp, Artificial Sequence
  Synthetic oligonucleotide
gacgttact

SEQ ID NO: 23 - DNA, 9 bp, Artificial Sequence
  Synthetic oligonucleotide
gacgttgct

SEQ ID NO: 24 - DNA, 9 bp, Artificial Sequence
  Synthetic oligonucleotide
gacgaaacc

SEQ ID NO: 25 - DNA, 14 bp, Artificial Sequence
  Synthetic oligonucleotide
  misc_feature (1)..(1): n is a, c, g, or t
  misc_feature (14)..(14): n is a, c, g, or t
ngatgaggatgacn

SEQ ID NO: 26 - DNA, 14 bp, Artificial Sequence
  Synthetic oligonucleotide
  misc_feature (1)..(1): n is a, c, g, or t
  misc_feature (14)..(14): n is a, c, g, or t
naaactgcaaaagn

SEQ ID NO: 27 - DNA, 11 bp, Artificial Sequence
  Synthetic oligonucleotide
  misc_feature (1)..(1): n is a, c, g, or t
  misc_feature (11)..(11): n is a, c, g, or t
ngagtgaggan

SEQ ID NO: 28 - DNA, 11 bp, Artificial Sequence
  Synthetic oligonucleotide
  misc_feature (1)..(1): n is a, c, g, or t
  misc_feature (11)..(11): n is a, c, g, or t
ngacgctgctn

SEQ ID NO: 29 - DNA, 14 bp, Artificial Sequence
  Synthetic oligonucleotide
  misc_feature (1)..(1): n is a, c, g, or t
  misc_feature (14)..(14): n is a, c, g, or t
ngatgaggatgacn

SEQ ID NO: 30 - DNA, 14 bp, Artificial Sequence
  Synthetic oligonucleotide
  misc_feature (1)..(1): n is a, c, g, or t
  misc_feature (14)..(14): n is a, c, g, or t
naaactgcaaaagn

SEQ ID NO: 31 - DNA, 14 bp, Artificial Sequence
  Synthetic oligonucleotide
  misc_feature (1)..(1): n is a, c, g, or t
  misc_feature (14)..(14): n is a, c, g, or t
ngatgaggatgacn

SEQ ID NO: 32 - DNA, 12 bp, Artificial Sequence
  Synthetic oligonucleotide
gatgaggatgac

SEQ ID NO: 33 - DNA, 12 bp, Artificial Sequence
  Synthetic oligonucleotide
gatgaggatgac

SEQ ID NO: 34 - DNA, 14 bp, Artificial Sequence
  Synthetic oligonucleotide
  misc_feature (1)..(1): n is a, c, g, or t
  misc_feature (14)..(14): n is a, c, g, or t
naaactgcaaaagn

SEQ ID NO: 35 - DNA, 12 bp, Artificial Sequence
  Synthetic oligonucleotide
aaactgcaaaag

SEQ ID NO: 36 - DNA, 12 bp, Artificial Sequence
  Synthetic oligonucleotide
aaactgcaaaag

SEQ ID NO: 37 - DNA, 12 bp, Artificial Sequence
  Synthetic oligonucleotide
gatgaggatgac

SEQ ID NO: 38 - DNA, 12 bp, Artificial Sequence
  Synthetic oligonucleotide
gtcatcctcatc

SEQ ID NO: 39 - DNA, 12 bp, Artificial Sequence
  Synthetic oligonucleotide
aaactgcaaaag

SEQ ID NO: 40 - DNA, 11 bp, Artificial Sequence
  Synthetic oligonucleotide
  misc_feature (1)..(1): n is a, c, g, or t
  misc_feature (11)..(11): n is a, c, g, or t
ngagtgaggan

SEQ ID NO: 41 - DNA, 11 bp, Artificial Sequence
  Synthetic oligonucleotide
  misc_feature (1)..(1): n is a, c, g, or t
  misc_feature (11)..(11): n is a, c, g, or t
ngacgctgctn

SEQ ID NO: 42 - DNA, 18 bp, Artificial Sequence
  Synthetic oligonucleotide
ttcattacacctgcagct

SEQ ID NO: 43 - DNA, 43 bp, Artificial Sequence
  Synthetic oligonucleotide
ttcattacacctgcagctctcattttccatacagtcagtatca

SEQ ID NO: 44 - DNA, 43 bp, Artificial Sequence
  Synthetic oligonucleotide
tgatactgactgtatggaaaatgagagctgcaggtgtaatgaa

SEQ ID NO: 45 - DNA, 18 bp, Artificial Sequence
  Synthetic oligonucleotide
agaaggtcttaactatga

SEQ ID NO: 46 - protein, 34 aa, Artificial Sequence
  Synthetic polypeptide
LTPEQVVAIASNIGGKQALETVQRLLPVLCQAHG

SEQ ID NO: 47 - DNA, 19 bp, Artificial Sequence
  Synthetic oligonucleotide
tggagccatctggccgggt

SEQ ID NO: 48 - DNA, 19 bp, Artificial Sequence
  Synthetic oligonucleotide
  misc_feature (1)..(1): n is a, c, g, or t
nttcattacacctgcagct

SEQ ID NO: 49 - DNA, 19 bp, Artificial Sequence
  Synthetic oligonucleotide
  misc_feature (1)..(1): n is a, c, g, or t
ntcttccagaattgatact

SEQ ID NO: 50 - DNA, 19 bp, Artificial Sequence
  Synthetic oligonucleotide
  misc_feature (1)..(1): n is a, c, g, or t
nttcattacacctgcagct

SEQ ID NO: 51 - DNA, 19 bp, Artificial Sequence
  Synthetic oligonucleotide
  misc_feature (1)..(1): n is a, c, g, or t
ntcttccagaattgatact

SEQ ID NO: 52 - DNA, 18 bp, Artificial Sequence
  Synthetic oligonucleotide
ttcattacacctgcagct

SEQ ID NO: 53 - DNA, 18 bp, Artificial Sequence
  Synthetic oligonucleotide
tcttccagaattgatact

SEQ ID NO: 54 - DNA, 16 bp, Artificial Sequence
  Synthetic oligonucleotide
tcttcattacacctgc

SEQ ID NO: 55 - DNA, 13 bp, Artificial Sequence
  Synthetic oligonucleotide
tcattacacctgc

SEQ ID NO: 56 - DNA, 10 bp, Artificial Sequence
  Synthetic oligonucleotide
ttacacctgc

SEQ ID NO: 57 - DNA, 45 bp, Artificial Sequence
  Synthetic oligonucleotide
tcttcattacacctgcagctctcattttccatacagtcagtatca

SEQ ID NO: 58 - DNA, 45 bp, Artificial Sequence
  Synthetic oligonucleotide
tgatactgactgtatggaaaatgagagctgcaggtgtaatgaaga

SEQ ID NO: 59 - DNA, 16 bp, Artificial Sequence
  Synthetic oligonucleotide
tgatactgactgtatg

SEQ ID NO: 60 - DNA, 13 bp, Artificial Sequence
  Synthetic oligonucleotide
tactgactgtatg

SEQ ID NO: 61 - DNA, 10 bp, Artificial Sequence
  Synthetic oligonucleotide
tgactgtatg

SEQ ID NO: 62 - DNA, 16 bp, Artificial Sequence
  Synthetic oligonucleotide
tcttcattacacctgc

SEQ ID NO: 63 - DNA, 13 bp, Artificial Sequence
  Synthetic oligonucleotide
tcattacacctgc

SEQ ID NO: 64 - DNA, 10 bp, Artificial Sequence
  Synthetic oligonucleotide
ttacacctgc

SEQ ID NO: 65 - DNA, 45 bp, Artificial Sequence; identical to SEQ ID NO: 57
  Synthetic oligonucleotide

SEQ ID NO: 66 - DNA, 45 bp, Artificial Sequence; identical to SEQ ID NO: 58
  Synthetic oligonucleotide

SEQ ID NO: 67 - DNA, 16 bp, Artificial Sequence
  Synthetic oligonucleotide
tgatactgactgtatg

SEQ ID NO: 68 - DNA, 13 bp, Artificial Sequence
  Synthetic oligonucleotide
tactgactgtatg

SEQ ID NO: 69 - DNA, 10 bp, Artificial Sequence
  Synthetic oligonucleotide
tgactgtatg

SEQ ID NO: 70 - DNA, 10 bp, Artificial Sequence
  Synthetic oligonucleotide
tagttgaggc

SEQ ID NO: 71 - DNA, 10 bp, Artificial Sequence
  Synthetic oligonucleotide
caacacaatt

SEQ ID NO: 72 - DNA, 10 bp, Artificial Sequence
  Synthetic oligonucleotide
gtgcagaacc

SEQ ID NO: 73 - DNA, 10 bp, Artificial Sequence
  Synthetic oligonucleotide
cattatcaac

SEQ ID NO: 74 - DNA, 10 bp, Artificial Sequence
  Synthetic oligonucleotide
ttacgattaa

SEQ ID NO: 75 - DNA, 10 bp, Artificial Sequence
  Synthetic oligonucleotide
tccatagaaa

SEQ ID NO: 76 - DNA, 10 bp, Artificial Sequence
  Synthetic oligonucleotide
ggcgccttcc

SEQ ID NO: 77 - DNA, 10 bp, Artificial Sequence
  Synthetic oligonucleotide
atttatgtaa

SEQ ID NO: 78 - DNA, 10 bp, Artificial Sequence
  Synthetic oligonucleotide
aatatgggga

SEQ ID NO: 79 - DNA, 10 bp, Artificial Sequence
  Synthetic oligonucleotide
cgttagggac

SEQ ID NO: 80 - DNA, 16 bp, Artificial Sequence
  Synthetic oligonucleotide
atacagttaggtatca

SEQ ID NO: 81 - DNA, 16 bp, Artificial Sequence
  Synthetic oligonucleotide
atacagtcaagtattg

SEQ ID NO: 82 - DNA, 16 bp, Artificial Sequence
  Synthetic oligonucleotide
aacacacagtcattca

SEQ ID NO: 83 - DNA, 16 bp, Artificial Sequence
  Synthetic oligonucleotide
agcatacggtcagtca

SEQ ID NO: 84 - DNA, 16 bp, Artificial Sequence
  Synthetic oligonucleotide
cgcatacagtcattat

SEQ ID NO: 85 - DNA, 16 bp, Artificial Sequence
  Synthetic oligonucleotide
caatcagaatgtatca

SEQ ID NO: 86 - DNA, 16 bp, Artificial Sequence
  Synthetic oligonucleotide
gagttatacagtcaga

SEQ ID NO: 87 - DNA, 16 bp, Artificial Sequence
  Synthetic oligonucleotide
cgcagacacagtaact

SEQ ID NO: 88 - DNA, 16 bp, Artificial Sequence
  Synthetic oligonucleotide
gaccatacagtcataa

SEQ ID NO: 89 - DNA, 16 bp, Artificial Sequence
  Synthetic oligonucleotide
ggtatcatacagttag

SEQ ID NO: 90 - DNA, 10 bp, Artificial Sequence
  Synthetic oligonucleotide
catacagtca

SEQ ID NO: 91 - DNA, 10 bp, Artificial Sequence
  Synthetic oligonucleotide
cagttgcagt

SEQ ID NO: 92 - DNA, 10 bp, Artificial Sequence
  Synthetic oligonucleotide
ttattctcta

SEQ ID NO: 93 - DNA, 10 bp, Artificial Sequence
  Synthetic oligonucleotide
ttctcccagt

SEQ ID NO: 94 - DNA, 10 bp, Artificial Sequence
  Synthetic oligonucleotide
cctggaaaag

SEQ ID NO: 95 - DNA, 10 bp, Artificial Sequence
  Synthetic oligonucleotide
aggtgtttgc

SEQ ID NO: 96 - DNA, 10 bp, Artificial Sequence
  Synthetic oligonucleotide
catcaacaac

SEQ ID NO: 97 - DNA, 10 bp, Artificial Sequence
  Synthetic oligonucleotide
atgattatta

SEQ ID NO: 98 - DNA, 10 bp, Artificial Sequence
  Synthetic oligonucleotide
taacaaatcg

SEQ ID NO: 99 - DNA, 10 bp, Artificial Sequence
  Synthetic oligonucleotide
cctacttcta

SEQ ID NO: 100 - DNA, 10 bp, Artificial Sequence
  Synthetic oligonucleotide
tgtcgaacat

SEQ ID NO: 101 - DNA, 16 bp, Artificial Sequence
  Synthetic oligonucleotide
catccgcacagtaaca

SEQ ID NO: 102 - DNA, 16 bp, Artificial Sequence
  Synthetic oligonucleotide
cattcactcaatatgg

SEQ ID NO: 103 - DNA, 16 bp, Artificial Sequence
  Synthetic oligonucleotide
aagatagtcagtatat

SEQ ID NO: 104 - DNA, 16 bp, Artificial Sequence
  Synthetic oligonucleotide
acataggacagtatca

SEQ ID NO: 105 - DNA, 16 bp, Artificial Sequence
  Synthetic oligonucleotide
aatacggtctacatct

SEQ ID NO: 106 - DNA, 16 bp, Artificial Sequence
  Synthetic oligonucleotide
caaaatgtcagtttct

SEQ ID NO: 107 - DNA, 16 bp, Artificial Sequence
  Synthetic oligonucleotide
tatacatttggtatgt

SEQ ID NO: 108 - DNA, 16 bp, Artificial Sequence
  Synthetic oligonucleotide
tattctgtttgtatca

SEQ ID NO: 109 - DNA, 16 bp, Artificial Sequence
  Synthetic oligonucleotide
cagacactcagcattc

SEQ ID NO: 110 - DNA, 16 bp, Artificial Sequence
  Synthetic oligonucleotide
agcatacagtgtatgt

SEQ ID NO: 111 - DNA, 16 bp, Artificial Sequence
  Synthetic oligonucleotide
catacagtcagtatca

SEQ ID NO: 112 - DNA, 18 bp, Artificial Sequence
  Synthetic oligonucleotide
  misc_feature (1)..(1): n is a, c, g, or t
  misc_feature (18)..(18): n is a, c, g, or t
ntcttcattacacctgcn

SEQ ID NO: 113 - DNA, 18 bp, Artificial Sequence
  Synthetic oligonucleotide
  misc_feature (1)..(1): n is a, c, g, or t
  misc_feature (18)..(18): n is a, c, g, or t
ntgatactgactgtatgn

SEQ ID NO: 114 - DNA, 16 bp, Artificial Sequence
  Synthetic oligonucleotide
tcttcattacacctgc

SEQ ID NO: 115 - DNA, 15 bp, Artificial Sequence
  Synthetic oligonucleotide
tgatactgactgtat

SEQ ID NO: 116 - DNA, 18 bp, Artificial Sequence
  Synthetic oligonucleotide
  misc_feature (1)..(1): n is a, c, g, or t
  misc_feature (18)..(18): n is a, c, g, or t
ntcttcattacacctgcn

SEQ ID NO: 117 - DNA, 18 bp, Artificial Sequence
  Synthetic oligonucleotide
  misc_feature (1)..(1): n is a, c, g, or t
  misc_feature (18)..(18): n is a, c, g, or t
ntgatactgactgtatgn

SEQ ID NO: 118 - DNA, 20 bp, Artificial Sequence
  Synthetic oligonucleotide
ttacacctgctgatactgac

SEQ ID NO: 119 - DNA, 1104 bp, Artificial Sequence
  Synthetic oligonucleotide
taatacgactcactatagggagacccaagctggctagccaccatggactacaaagaccatgacggtgattataaagatcatgacatcgattacaaggatgacgatgacaagatggcccccaagaagaagaggaaggtgggcattcacggggtacccgccgctatggctgagaggcccttccagtgtcgaatctgcatgcgtaacttcagtgatcgctctaacctgagtcggcacatccgcacccacacaggcgagaagccttttgcctgtgacatttgtgggaggaagtttgccatctcctccaacctgaactcccataccaagatacacacgggatctcagaagcccttccagtgtcgaatctgcatgcgtaacttcagtcgctccgacaacctggcccgccacatccgcacccacacaggcgagaagccttttgcctgtgacatttgtgggaggaaatttgccacctccggcaacctgacccgccataccaagatacacctgcggggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatgcaacgatatgtcaaagaaaatcaaacacgaaacaaacatatcaaccctaatgaatggtggaaagtctatccatcttctgtaacggaatttaagtttttatttgtgagtggtcactttaaaggaaactacaaagctcagcttacacgattaaatcataagactaattgtaatggagctgttcttagtgtagaagagcttttaattggtggagaaatgattaaagccggcacattaaccttagaggaagtgagacggaaatttaataacggcgagataaacttttaa

SEQ ID NO: 120 - protein, 353 aa, Artificial Sequence
  Synthetic polypeptide
MDYKDHDGDYKDHDIDYKDDDDKMAPKKKRKVGIHGVPAAMAERPFQCRICMRNFSDRSNLSRHIRTHTGEKPFACDICGRKFAISSNLNSHTKIHTGSQKPFQCRICMRNFSRSDNLARHIRTHTGEKPFACDICGRKFATSGNLTRHTKIHLRGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 121 - DNA, 1101 bp, Artificial Sequence
  Synthetic oligonucleotide
taatacgactcactatagggagacccaagctggctagccaccatggactacaaagaccatgacggtgattataaagatcatgacatcgattacaaggatgacgatgacaagatggcccccaagaagaagaggaaggtgggcattcacggggtacctgccgctatggctgagaggcccttccagtgtcgaatctgcatgcgtaacttcagtcgctccgacaacctgtccgtgcacatccgcacccacacaggcgagaagccttttgcctgtgacatttgtgggaggaagtttgcccagaagatcaacctgcaggtgcataccaagatacacaccggcgagaagcccttccagtgtcgaatctgcatgcgtaacttcagtcgctccgacgtgctgtccgagcacatccgcacccacacaggcgagaagccttttgcctgtgacatttgtgggaggaaatttgcccagcgcaaccaccgcaccacccataccaagatacacctgcggggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatggagcgatatgtcgaagaaaatcaaacacgaaacaaacatctcaaccctaatgaatggtggaaagtctatccatcttctgtaacggaatttaagtttttatttgtgagtggtcactttaaaggaaactacaaagctcagcttacacgattaaatcatatcactaattgtaatggagctgttcttagtgtagaagagcttttaattggtggagaaatgattaaagccggcacattaaccttagaggaagtgagacggaaatttaataacggcgagataaacttttaa

SEQ ID NO: 122 - protein, 352 aa, Artificial Sequence
  Synthetic polypeptide
MDYKDHDGDYKDHDIDYKDDDDKMAPKKKRKVGIHGVPAAMAERPFQCRICMRNFSRSDNLSVHIRTHTGEKPFACDICGRKFAQKINLQVHTKIHTGEKPFQCRICMRNFSRSDVLSEHIRTHTGEKPFACDICGRKFAQRNHRTTHTKIHLRGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 123 - DNA, 1017 bp, Artificial Sequence
  Synthetic oligonucleotide
taatacgactcactatagggagacccaagctggctagccaccatggactacaaagaccatgacggtgattataaagatcatgacatcgattacaaggatgacgatgacaagatggcccccaagaagaagaggaaggtgggcattcacggggtgccgtctagacccggggagcgccccttccagtgtcgcatttgcatgcggaacttttcgcgccaggacaggcttgacaggcatacccgtactcataccggtgaaaaaccgtttcagtgtcggatctgtatgcgaaatttctcccagaaggagcacttggcggggcatctacgtacgcacaccggcgagaagccattccaatgccgaatatgcatgcgcaacttcagtcgccgcgacaacctgaaccggcacctaaaaacccacctgaggggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatgcaacgatatgtcaaagaaaatcaaacacgaaacaaacatatcaaccctaatgaatggtggaaagtctatccatcttctgtaacggaatttaagtttttatttgtgagtggtcactttaaaggaaactacaaagctcagcttacacgattaaatcataagactaattgtaatggagctgttcttagtgtagaagagcttttaattggtggagaaatgattaaagccggcacattaaccttagaggaagtgagacggaaatttaataacggcgagataaacttttaa

SEQ ID NO: 124 - protein, 324 aa, Artificial Sequence
  Synthetic polypeptide
MDYKDHDGDYKDHDIDYKDDDDKMAPKKKRKVGIHGVPSRPGERPFQCRICMRNFSRQDRLDRHTRTHTGEKPFQCRICMRNFSQKEHLAGHLRTHTGEKPFQCRICMRNFSRRDNLNRHLKTHLRGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 125 - DNA, 1017 bp, Artificial Sequence
  Synthetic oligonucleotide
taatacgactcactatagggagacccaagctggctagccaccatggactacaaagaccatgacggtgattataaagatcatgacatcgattacaaggatgacgatgacaagatggcccccaagaagaagaggaaggtgggcattcacggggtgccgtctagacccggggagcgccccttccagtgtcgcatttgcatgcggaacttttcgaccggccagatccttgaccgccatacccgtactcataccggtgaaaaaccgtttcagtgtcggatctgtatgcgaaatttctccgtggcgcacagcttgaagaggcatctacgtacgcacaccggcgagaagccattccaatgccgaatatgcatgcgcaacttcagtgaccccagcaacctgcggcgccacctaaaaacccacctgaggggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatggagcgatatgtcgaagaaaatcaaacacgaaacaaacatctcaaccctaatgaatggtggaaagtctatccatcttctgtaacggaatttaagtttttatttgtgagtggtcactttaaaggaaactacaaagctcagcttacacgattaaatcatatcactaattgtaatggagctgttcttagtgtagaagagcttttaattggtggagaaatgattaaagccggcacattaaccttagaggaagtgagacggaaatttaataacggcgagataaacttttaa

SEQ ID NO: 126 - protein, 324 aa, Artificial Sequence
  Synthetic polypeptide
MDYKDHDGDYKDHDIDYKDDDDKMAPKKKRKVGIHGVPSRPGERPFQCRICMRNFSTGQILDRHTRTHTGEKPFQCRICMRNFSVAHSLKRHLRTHTGEKPFQCRICMRNFSDPSNLRRHLKTHLRGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 127 - DNA, 10 bp, Artificial Sequence
  Synthetic oligonucleotide
cgatcgttgg

SEQ ID NO: 128 - DNA, 10 bp, Artificial Sequence
  Synthetic oligonucleotide
cagtggaacg

SEQ ID NO: 129 - DNA, 12 bp, Artificial Sequence
  Synthetic oligonucleotide
gatgaggatgac

SEQ ID NO: 130 - DNA, 9 bp, Artificial Sequence
  Synthetic oligonucleotide
gacgctgct

SEQ ID NO: 131 - DNA, 12 bp, Artificial Sequence
  Synthetic oligonucleotide
aaactgcaaaag

SEQ ID NO: 132 - DNA, 9 bp, Artificial Sequence
  Synthetic oligonucleotide
gagtgagga

SEQ ID NO: 133 - DNA, 40 bp, Artificial Sequence
  Synthetic oligonucleotide
tcgttgggaaccggagctgaatgaagccataccaaacgac

SEQ ID NO: 134 - DNA, 12 bp, Artificial Sequence
  Synthetic oligonucleotide
gtcatcctcatc

SEQ ID NO: 135 - DNA, 12 bp, Artificial Sequence
  Synthetic oligonucleotide
aaactgcaaaag

SEQ ID NO: 136 - DNA, 9 bp, Artificial Sequence
  Synthetic oligonucleotide
agcagcgtc

SEQ ID NO: 137 - DNA, 9 bp, Artificial Sequence
  Synthetic oligonucleotide
gagtgagga

SEQ ID NO: 138 - DNA, 7 bp, Artificial Sequence
  Synthetic oligonucleotide
ccacgct

SEQ ID NO: 139 - DNA, 10 bp, Artificial Sequence
  Synthetic oligonucleotide
cctcgggact

SEQ ID NO: 140 - DNA, 7 bp, Artificial Sequence
  Synthetic oligonucleotide
ccacgct

SEQ ID NO: 141 - DNA, 10 bp, Artificial Sequence
  Synthetic oligonucleotide
cctcgggact

SEQ ID NO: 142 - DNA, 7 bp, Artificial Sequence
  Synthetic oligonucleotide
ccacgct

SEQ ID NO: 143 - DNA, 10 bp, Artificial Sequence
  Synthetic oligonucleotide
cctcgggact

SEQ ID NO: 144 - DNA, 7 bp, Artificial Sequence
  Synthetic oligonucleotide
ccacgct

SEQ ID NO: 145 - DNA, 10 bp, Artificial Sequence
  Synthetic oligonucleotide
cctcgggact

SEQ ID NO: 146 - DNA, 7 bp, Artificial Sequence
  Synthetic oligonucleotide
ccacgct

SEQ ID NO: 147 - DNA, 10 bp, Artificial Sequence
  Synthetic oligonucleotide
cctcgggact

SEQ ID NO: 148 - DNA, 7 bp, Artificial Sequence
  Synthetic oligonucleotide
ccacgct

SEQ ID NO: 149 - DNA, 10 bp, Artificial Sequence
  Synthetic oligonucleotide
cctcgggact

SEQ ID NO: 150 - DNA, 7 bp, Artificial Sequence
  Synthetic oligonucleotide
ccacgct

SEQ ID NO: 151 - DNA, 10 bp, Artificial Sequence
  Synthetic oligonucleotide
cctcgggact

SEQ ID NO: 152 - DNA, 7 bp, Artificial Sequence
  Synthetic oligonucleotide
ccacgct

SEQ ID NO: 153 - DNA, 10 bp, Artificial Sequence
  Synthetic oligonucleotide
cctcgggact

SEQ ID NO: 154 - DNA, 7 bp, Artificial Sequence
  Synthetic oligonucleotide
ccacgct

SEQ ID NO: 155 - DNA, 10 bp, Artificial Sequence
  Synthetic oligonucleotide
cctcgggact

SEQ ID NO: 156 - DNA, 7 bp, Artificial Sequence
  Synthetic oligonucleotide
ccacgct

SEQ ID NO: 157 - DNA, 10 bp, Artificial Sequence
  Synthetic oligonucleotide
cctcgggact

SEQ ID NO: 158 - DNA, 63 bp, Artificial Sequence
  Synthetic oligonucleotide
aatgatacggcgaccaccgagatctacactctttccctacacgacgctcttccgatctcgtaa

SEQ ID NO: 159 - DNA, 50 bp, Artificial Sequence
  Synthetic oligonucleotide
ttacgagatcggaagagcgtcgtgtagggaaagagtgtagatctcggtgg

SEQ ID NO: 160 - DNA, 63 bp, Artificial Sequence
  Synthetic oligonucleotide
aatgatacggcgaccaccgagatctacactctttccctacacgacgctcttccgatctgtact

SEQ ID NO: 161 - DNA, 50 bp, Artificial Sequence
  Synthetic oligonucleotide
agtacagatcggaagagcgtcgtgtagggaaagagtgtagatctcggtgg

SEQ ID NO: 162 - DNA, 63 bp, Artificial Sequence
  Synthetic oligonucleotide
aatgatacggcgaccaccgagatctacactctttccctacacgacgctcttccgatcttacga

SEQ ID NO: 163 - DNA, 50 bp, Artificial Sequence
  Synthetic oligonucleotide
tcgtaagatcggaagagcgtcgtgtagggaaagagtgtagatctcggtgg

SEQ ID NO: 164 - DNA, 63 bp, Artificial Sequence
  Synthetic oligonucleotide
aatgatacggcgaccaccgagatctacactctttccctacacgacgctcttccgatctatgct

SEQ ID NO: 165 - DNA, 50 bp, Artificial Sequence
  Synthetic oligonucleotide
agcatagatcggaagagcgtcgtgtagggaaagagtgtagatctcggtgg

SEQ ID NO: 166 - DNA, 63 bp, Artificial Sequence
  Synthetic oligonucleotide
aatgatacggcgaccaccgagatctacactctttccctacacgacgctcttccgatcttgcaa

SEQ ID NO: 167 - DNA, 50 bp, Artificial Sequence
  Synthetic oligonucleotide
ttgcaagatcggaagagcgtcgtgtagggaaagagtgtagatctcggtgg

SEQ ID NO: 168 - DNA, 63 bp, Artificial Sequence
  Synthetic oligonucleotide
aatgatacggcgaccaccgagatctacactctttccctacacgacgctcttccgatctgcatt

SEQ ID NO: 169 - DNA, 50 bp, Artificial Sequence
  Synthetic oligonucleotide
aatgcagatcggaagagcgtcgtgtagggaaagagtgtagatctcggtgg

SEQ ID NO: 170 - DNA, 63 bp, Artificial Sequence
  Synthetic oligonucleotide
aatgatacggcgaccaccgagatctacactctttccctacacgacgctcttccgatctgacta

SEQ ID NO: 171 - DNA, 50 bp, Artificial Sequence
  Synthetic oligonucleotide
tagtcagatcggaagagcgtcgtgtagggaaagagtgtagatctcggtgg

SEQ ID NO: 172 - DNA, 63 bp, Artificial Sequence
  Synthetic oligonucleotide
aatgatacggcgaccaccgagatctacactctttccctacacgacgctcttccgatctactgt

SEQ ID NO: 173 - DNA, 50 bp, Artificial Sequence
  Synthetic oligonucleotide
acagtagatcggaagagcgtcgtgtagggaaagagtgtagatctcggtgg

SEQ ID NO: 174 - DNA, 63 bp, Artificial Sequence
  Synthetic oligonucleotide
aatgatacggcgaccaccgagatctacactctttccctacacgacgctcttccgatctctgaa

SEQ ID NO: 175 - DNA, 50 bp, Artificial Sequence
  Synthetic oligonucleotide
ttcagagatcggaagagcgtcgtgtagggaaagagtgtagatctcggtgg

SEQ ID NO: 176 - DNA, 60 bp, Artificial Sequence
  Synthetic oligonucleotide
caagcagaagacggcatacgagatcgtgatgtgactggagttcagacgtgtgctcttccg

SEQ ID NO: 177 - DNA, 42 bp, Artificial Sequence
  Synthetic oligonucleotide
  misc_feature (22)..(25): n is a, c, g, or t
cagacgtgtgctcttccgatcnnnnagcgtggagtcccgagg

SEQ ID NO: 178 - DNA, 84 bp, Artificial Sequence
  Synthetic oligonucleotide
  misc_feature (64)..(67): n is a, c, g, or t
caagcagaagacggcatacgagatacagtcgtgactggagttcagacgtgtgctcttccgatcnnnnagcgtggagtcccgagg

SEQ ID NO: 179 - DNA, 73 bp, Artificial Sequence
  Synthetic oligonucleotide
tcgggaacgtgatcggaagagcacacgtctgaactccagtcaccgtctaatctcgtatgccgtcttctgcttg

SEQ ID NO: 180 - DNA, 38 bp, Artificial Sequence
  Synthetic oligonucleotide
gtgactggagttcagacgtgtgctcttccgatcacgtt

SEQ ID NO: 181 - DNA, 73 bp, Artificial Sequence
  Synthetic oligonucleotide
tcgggacgtagatcggaagagcacacgtctgaactccagtcaccgtctaatctcgtatgccgtcttctgcttg

SEQ ID NO: 182 - DNA, 38 bp, Artificial Sequence
  Synthetic oligonucleotide
gtgactggagttcagacgtgtgctcttccgatctacgt

SEQ ID NO: 183 - DNA, 73 bp, Artificial Sequence
  Synthetic oligonucleotide
tcgggagtacgatcggaagagcacacgtctgaactccagtcaccgtctaatctcgtatgccgtcttctgcttg

SEQ ID NO: 184 - DNA, 38 bp, Artificial Sequence
  Synthetic oligonucleotide
gtgactggagttcagacgtgtgctcttccgatcgtact

SEQ ID NO: 185 - DNA, 73 bp, Artificial Sequence
  Synthetic oligonucleotide
tcgggatacggatcggaagagcacacgtctgaactccagtcaccgtctaatctcgtatgccgtcttctgcttg

SEQ ID NO: 186 - DNA, 38 bp, Artificial Sequence
  Synthetic oligonucleotide
gtgactggagttcagacgtgtgctcttccgatccgtat

SEQ ID NO: 187 - DNA, 79 bp, Artificial Sequence
  Synthetic oligonucleotide
  misc_feature (59)..(62): n is a, c, g, or t
aatgatacggcgaccaccgagatctacactctttccctacacgacgctcttccgatctnnnncctcgggactccacgct

SEQ ID NO: 188 - DNA, 17 bp, Artificial Sequence
  Synthetic oligonucleotide
aatgatacggcgaccac

SEQ ID NO: 189 - DNA, 21 bp, Artificial Sequence
  Synthetic oligonucleotide
caagcagaagacggcatacga

SEQ ID NO: 190 - DNA, 12 bp, Artificial Sequence
  Synthetic oligonucleotide
gtcatcctcatc

SEQ ID NO: 191 - DNA, 12 bp, Artificial Sequence
  Synthetic oligonucleotide
gtcgtcctcatc

SEQ ID NO: 192 - DNA, 12 bp, Artificial Sequence
  Synthetic oligonucleotide
gttttcctcatc

SEQ ID NO: 193 - DNA, 12 bp, Artificial Sequence
  Synthetic oligonucleotide
gtcatcctcatc

SEQ ID NO: 194 - DNA, 12 bp, Artificial Sequence
  Synthetic oligonucleotide
taaatcctcatc

SEQ ID NO: 195 - DNA, 12 bp, Artificial Sequence
  Synthetic oligonucleotide
gtcatcccaatc

SEQ ID NO: 196 - DNA, 12 bp, Artificial Sequence
  Synthetic oligonucleotide
ctcatcctcatc

SEQ ID NO: 197 - DNA, 12 bp, Artificial Sequence
  Synthetic oligonucleotide
gtcatcctcagc

SEQ ID NO: 198 - DNA, 12 bp, Artificial Sequence
  Synthetic oligonucleotide
gtcatcttcatc

SEQ ID NO: 199 - DNA, 12 bp, Artificial Sequence
  Synthetic oligonucleotide
gtcatcctcatc

SEQ ID NO: 200 - DNA, 12 bp, Artificial Sequence
  Synthetic oligonucleotide
gtcatcttcatc

SEQ ID NO: 201 - DNA, 12 bp, Artificial Sequence
  Synthetic oligonucleotide
gtcatcctcata

SEQ ID NO: 202 - DNA, 12 bp, Artificial Sequence
  Synthetic oligonucleotide
atcatcctcatc

SEQ ID NO: 203 - DNA, 12 bp, Artificial Sequence
  Synthetic oligonucleotide
gtcctgctcagc

SEQ ID NO: 204 - DNA, 12 bp, Artificial Sequence
  Synthetic oligonucleotide
atgttcctcatc

SEQ ID NO: 205 - DNA, 12 bp, Artificial Sequence
  Synthetic oligonucleotide
gtcttcctgatg

SEQ ID NO: 206 - DNA, 12 bp, Artificial Sequence
  Synthetic oligonucleotide
aacatccacatc

SEQ ID NO: 207 - DNA, 12 bp, Artificial Sequence
  Synthetic oligonucleotide
atcttcctcatt

SEQ ID NO: 208 - DNA, 12 bp, Artificial Sequence
  Synthetic oligonucleotide
ggcttcctgacc

SEQ ID NO: 209 - DNA, 12 bp, Artificial Sequence
  Synthetic oligonucleotide
gttttgcacatt

SEQ ID NO: 210 - DNA, 12 bp, Artificial Sequence
  Synthetic oligonucleotide
gtcaacctcaac

SEQ ID NO: 211 - DNA, 12 bp, Artificial Sequence
  Synthetic oligonucleotide
gtcatcctcctc

SEQ ID NO: 212 - DNA, 12 bp, Artificial Sequence
  Synthetic oligonucleotide
gtcttcctcctc

SEQ ID NO: 213 - DNA, 12 bp, Artificial Sequence
  Synthetic oligonucleotide
gtgatactcatc

SEQ ID NO: 214 - DNA, 12 bp, Artificial Sequence
  Synthetic oligonucleotide
gttatcctcagc

SEQ ID NO: 215 - DNA, 12 bp, Artificial Sequence
  Synthetic oligonucleotide
ctcatgctcatc

SEQ ID NO: 216 - DNA, 12 bp, Artificial Sequence
  Synthetic oligonucleotide
gccagtctcagc

SEQ ID NO: 217 - DNA, 12 bp, Artificial Sequence
  Synthetic oligonucleotide
ctcattctgttc

SEQ ID NO: 218 - DNA, 12 bp, Artificial Sequence
  Synthetic oligonucleotide
gaagtcctcatc

SEQ ID NO: 219 - DNA, 12 bp, Artificial Sequence
  Synthetic oligonucleotide
gtcttcctcttt

SEQ ID NO: 220 - DNA, 12 bp, Artificial Sequence
  Synthetic oligonucleotide
ataatccttttc

SEQ ID NO: 221 - DNA, 12 bp, Artificial Sequence
  Synthetic oligonucleotide
gacatccaaatt

SEQ ID NO: 222 - DNA, 12 bp, Artificial Sequence
  Synthetic oligonucleotide
gtcttgctgttg

SEQ ID NO: 223 - DNA, 12 bp, Artificial Sequence
  Synthetic oligonucleotide
gtcatccgcatc

SEQ ID NO: 224 - DNA, 12 bp, Artificial Sequence
  Synthetic oligonucleotide
atcatcctcaac

SEQ ID NO: 225 - DNA, 12 bp, Artificial Sequence
  Synthetic oligonucleotide
ggaatgcccatc

SEQ ID NO: 226 - DNA, 12 bp, Artificial Sequence
  Synthetic oligonucleotide
gttttgctcctg

SEQ ID NO: 227 - DNA, 12 bp, Artificial Sequence
  Synthetic oligonucleotide
aaactgcaaaag

SEQ ID NO: 228 - DNA, 12 bp, Artificial Sequence
  Synthetic oligonucleotide
aaactgcaaaaa

SEQ ID NO: 229 - DNA, 12 bp, Artificial Sequence
  Synthetic oligonucleotide
aaactgcaaaat

SEQ ID NO: 230 - DNA, 12 bp, Artificial Sequence
  Synthetic oligonucleotide
aaactggctaat

SEQ ID NO: 231 - DNA, 12 bp, Artificial Sequence
  Synthetic oligonucleotide
aaaatgcaaaag

SEQ ID NO: 232 - DNA, 12 bp, Artificial Sequence
  Synthetic oligonucleotide
aaactgaaaaag

SEQ ID NO: 233 - DNA, 12 bp, Artificial Sequence
  Synthetic oligonucleotide
acaatgcaaaag

SEQ ID NO: 234 - DNA, 12 bp, Artificial Sequence
  Synthetic oligonucleotide
aaacagcagaag

SEQ ID NO: 235 - DNA, 12 bp, Artificial Sequence
  Synthetic oligonucleotide
gaactgcaaaac

SEQ ID NO: 236 - DNA, 12 bp, Artificial Sequence
  Synthetic oligonucleotide
aaagaacaaagg

SEQ ID NO: 237 - DNA, 12 bp, Artificial Sequence
  Synthetic oligonucleotide
aaactgtaaagt

SEQ ID NO: 238 - DNA, 12 bp, Artificial Sequence
  Synthetic oligonucleotide
aaactgccttag

SEQ ID NO: 239 - DNA, 12 bp, Artificial Sequence
  Synthetic oligonucleotide
aatgttcaaaag

SEQ ID NO: 240 - DNA, 12 bp, Artificial Sequence
  Synthetic oligonucleotide
aaactgaaaaag

SEQ ID NO: 241 - DNA, 12 bp, Artificial Sequence
  Synthetic oligonucleotide
aaactgcaaatg

SEQ ID NO: 242 - DNA, 12 bp, Artificial Sequence
  Synthetic oligonucleotide
aaactggaaaag

SEQ ID NO: 243 - DNA, 12 bp, Artificial Sequence
  Synthetic oligonucleotide
aaactgcaaaaa

SEQ ID NO: 244 - DNA, 12 bp, Artificial Sequence
  Synthetic oligonucleotide
aaaatgtaatag

SEQ ID NO: 245 - DNA, 12 bp, Artificial Sequence
  Synthetic oligonucleotide
aaactgtaaatg

SEQ ID NO: 246 - DNA, 12 bp, Artificial Sequence
  Synthetic oligonucleotide
taactgcaaaag

SEQ ID NO: 247 - DNA, 12 bp, Artificial Sequence
  Synthetic oligonucleotide
agactgcaaaag

SEQ ID NO: 248 - DNA, 12 bp, Artificial Sequence
  Synthetic oligonucleotide
caattgctaaag

SEQ ID NO: 249 - DNA, 12 bp, Artificial Sequence
  Synthetic oligonucleotide
tcactgcaaaag

SEQ ID NO: 250 - DNA, 12 bp, Artificial Sequence
  Synthetic oligonucleotide
aatctgcataag

SEQ ID NO: 251 - DNA, 12 bp, Artificial Sequence
  Synthetic oligonucleotide
aaactggaacag

SEQ ID NO: 252 - DNA, 12 bp, Artificial Sequence
  Synthetic oligonucleotide
taactgcaaaat

SEQ ID NO: 253 - DNA, 12 bp, Artificial Sequence
  Synthetic oligonucleotide
aaactgcaaaag

SEQ ID NO: 254 - DNA, 12 bp, Artificial Sequence
  Synthetic oligonucleotide
aaactgcaaaag

SEQ ID NO: 255 - DNA, 12 bp, Artificial Sequence
  Synthetic oligonucleotide
aaactgaaagag

SEQ ID NO: 256 - DNA, 12 bp, Artificial Sequence
  Synthetic oligonucleotide
aaaccgcaaatg

SEQ ID NO: 257 - DNA, 12 bp, Artificial Sequence
  Synthetic oligonucleotide
aaacagcaaaag

SEQ ID NO: 258 - DNA, 12 bp, Artificial Sequence
  Synthetic oligonucleotide
aaactgaaaaag

SEQ ID NO: 259 - DNA, 12 bp, Artificial Sequence
  Synthetic oligonucleotide
aaactgcaaaag

SEQ ID NO: 260 - DNA, 12 bp, Artificial Sequence
  Synthetic oligonucleotide
gaactggaaaaa

SEQ ID NO: 261 - DNA, 12 bp, Artificial Sequence
  Synthetic oligonucleotide
aaacaggaaaag

SEQ ID NO: 262 - DNA, 12 bp, Artificial Sequence
  Synthetic oligonucleotide
aaactgcaaaag

SEQ ID NO: 263 - DNA, 12 bp, Artificial Sequence
  Synthetic oligonucleotide
aaactgcaaaag

SEQ ID NO: 264 - DNA, 29 bp, Artificial Sequence
  Synthetic oligonucleotide
gtcatcctcatcctgataaactgcaaaag

SEQ ID NO: 265 - DNA, 29 bp, Artificial Sequence
  Synthetic oligonucleotide
gtcgtcctcatcttaataaactgcaaaaa

SEQ ID NO: 266 - DNA, 29 bp, Artificial Sequence
  Synthetic oligonucleotide
gttttcctcatcaaagcaaactgcaaaat

SEQ ID NO: 267 - DNA, 29 bp, Artificial Sequence
  Synthetic oligonucleotide
gtcatcctcatcagagaaaactggctaat

SEQ ID NO: 268 - DNA, 30 bp, Artificial Sequence
  Synthetic oligonucleotide
taaatcctcatctctataaaaatgcaaaag

SEQ ID NO: 269 - DNA, 30 bp, Artificial Sequence
  Synthetic oligonucleotide
gtcatcccaatcgaagaaaaactgaaaaag

SEQ ID NO: 270 - DNA, 29 bp, Artificial Sequence
  Synthetic oligonucleotide
ctcatcctcatccatgcacaatgcaaaag

SEQ ID NO: 271 - DNA, 29 bp, Artificial Sequence
  Synthetic oligonucleotide
gtcatcctcagcatgggaaacagcagaag

SEQ ID NO: 272 - DNA, 29 bp, Artificial Sequence
  Synthetic oligonucleotide
gtcatcttcatcaaaaggaactgcaaaac

SEQ ID NO: 273 - DNA, 29 bp, Artificial Sequence
  Synthetic oligonucleotide
gtcatcctcatccaataaaagaacaaagg

SEQ ID NO: 274 - DNA, 29 bp, Artificial Sequence
  Synthetic oligonucleotide
gtcatcttcatcagcataaactgtaaagt

SEQ ID NO: 275 - DNA, 29 bp, Artificial Sequence
  Synthetic oligonucleotide
gtcatcctcatacataaaaactgccttag

SEQ ID NO: 276 - DNA, 29 bp, Artificial Sequence
  Synthetic oligonucleotide
atcatcctcatccatccaatgttcaaaag

SEQ ID NO: 277 - DNA, 29 bp, Artificial Sequence
  Synthetic oligonucleotide
gtcctgctcagcaaaagaaactgaaaaag

SEQ ID NO: 278 - DNA, 29 bp, Artificial Sequence
  Synthetic oligonucleotide
atgttcctcatctcccgaaactgcaaatg

SEQ ID NO: 279 - DNA, 29 bp, Artificial Sequence
  Synthetic oligonucleotide
gtcttcctgatgctaccaaactggaaaag

SEQ ID NO: 280 - DNA, 29 bp, Artificial Sequence
  Synthetic oligonucleotide
aacatccacatcatgaaaaactgcaaaaa

SEQ ID NO: 281 - DNA, 29 bp, Artificial Sequence
  Synthetic oligonucleotide
atcttcctcattacaggaaaatgtaatag

SEQ ID NO: 282 - DNA, 29 bp, Artificial Sequence
  Synthetic oligonucleotide
ggcttcctgacccacggaaactgtaaatg

SEQ ID NO: 283 - DNA, 29 bp, Artificial Sequence
  Synthetic oligonucleotide
gttttgcacatttcaattaactgcaaaag

SEQ ID NO: 284 - DNA, 30 bp, Artificial Sequence
  Synthetic oligonucleotide
gtcaacctcaacacctacagactgcaaaag

SEQ ID NO: 285 - DNA, 30 bp, Artificial Sequence
  Synthetic oligonucleotide
gtcatcctcctccaactccaattgctaaag

SEQ ID NO: 286 - DNA, 30 bp, Artificial Sequence
  Synthetic oligonucleotide
gtcttcctcctctgcacatcactgcaaaag

SEQ ID NO: 287 - DNA, 30 bp, Artificial Sequence
  Synthetic oligonucleotide
gtgatactcatcatcagcaatctgcataag

SEQ ID NO: 288 - DNA, 30 bp, Artificial Sequence
  Synthetic oligonucleotide
gttatcctcagcaaactaaaactggaacag

SEQ ID NO: 289 - DNA, 30 bp, Artificial Sequence
  Synthetic oligonucleotide
ctcatgctcatcatttgttaactgcaaaat

SEQ ID NO: 290 - DNA, 30 bp, Artificial Sequence
  Synthetic oligonucleotide
gccagtctcagcatggtgaaactgcaaaag

SEQ ID NO: 291 - DNA, 30 bp, Artificial Sequence
  Synthetic oligonucleotide
ctcattctgttcatgaaaaaactgcaaaag

SEQ ID NO: 292 - DNA, 30 bp, Artificial Sequence
  Synthetic oligonucleotide
gaagtcctcatcccgaagaaactgaaagag

SEQ ID NO: 293 - DNA, 30 bp, Artificial Sequence
  Synthetic oligonucleotide
gtcttcctctttcacataaaaccgcaaatg

SEQ ID NO: 294 - DNA, 30 bp, Artificial Sequence
  Synthetic oligonucleotide
ataatccttttctgtttaaaacagcaaaag

SEQ ID NO: 295 - DNA, 30 bp, Artificial Sequence
  Synthetic oligonucleotide
gacatccaaattacatggaaactgaaaaag

SEQ ID NO: 296 - DNA, 30 bp, Artificial Sequence
  Synthetic oligonucleotide
gtcttgctgttgcacctcaaactgcaaaag

SEQ ID NO: 297 - DNA, 30 bp, Artificial Sequence
  Synthetic oligonucleotide
gtcatccgcatcgccctggaactggaaaaa

SEQ ID NO: 298 - DNA, 30 bp, Artificial Sequence
  Synthetic oligonucleotide
atcatcctcaacaaactaaaacaggaaaag

SEQ ID NO: 299 - DNA, 30 bp, Artificial Sequence
  Synthetic oligonucleotide
ggaatgcccatcaccacaaaactgcaaaag

SEQ ID NO: 300 - DNA, 30 bp, Artificial Sequence
  Synthetic oligonucleotide
gttttgctcctgtacttcaaactgcaaaag

SEQ ID NO: 301 - DNA, 29 bp, Artificial Sequence
  Synthetic oligonucleotide
attttgcagtttgctttgatgaggaaaac

SEQ ID NO: 302 - DNA, 29 bp, Artificial Sequence
  Synthetic oligonucleotide
attttgcagtttgctttgatgaggaaaac

SEQ ID NO: 303 - DNA, 34 bp, Artificial Sequence
  Synthetic oligonucleotide
attttgcagtttgctttgctttgatgaggaaaac

SEQ ID NO: 304 - DNA, 34 bp, Artificial Sequence
  Synthetic oligonucleotide
attttgcagtttggtttgctttgatgaggaaaac

SEQ ID NO: 305 - DNA, 34 bp, Artificial Sequence
  Synthetic oligonucleotide
attttgcagtttgctttgctttggtgaggaaaac

SEQ ID NO: 306 - DNA, 34 bp, Artificial Sequence
  Synthetic oligonucleotide
gttttgcagtttgctttgctttgatgaggaaaac

SEQ ID NO: 307 - DNA, 34 bp, Artificial Sequence
  Synthetic oligonucleotide
cttttgcaggttgctttgctttgatgaggaaaac

SEQ ID NO: 308 - DNA, 34 bp, Artificial Sequence
  Synthetic oligonucleotide
attttgcagtttgctttgctttgatgtggaaaac

SEQ ID NO: 309 - DNA, 29 bp, Artificial Sequence
  Synthetic oligonucleotide
attttgcagtttgctttgatgaggaaaac

SEQ ID NO: 310 - DNA, 29 bp, Artificial Sequence
  Synthetic oligonucleotide
gttttgcagttccttttgatgaagatgac

SEQ ID NO: 311 - DNA, 29 bp, Artificial Sequence
  Synthetic oligonucleotide
gttttgcagttccttttgatgaagatgac

SEQ ID NO: 312 - DNA, 29 bp, Artificial Sequence
  Synthetic oligonucleotide
gttttgcaggtccttttgatgaagatgac

SEQ ID NO: 313 - DNA, 29 bp, Artificial Sequence
  Synthetic oligonucleotide
actttacagtttatgctgatgaagatgac

SEQ ID NO: 314 - DNA, 29 bp, Artificial Sequence
  Synthetic oligonucleotide
actttacagtttatgctgatgaagatgac

SEQ ID NO: 315 - DNA, 29 bp, Artificial Sequence
  Synthetic oligonucleotide
actttacagtttatgctgatgaagatgac

SEQ ID NO: 316 - DNA, 29 bp, Artificial Sequence
  Synthetic oligonucleotide
gctttacagtttatgctgatgaagatgac

SEQ ID NO: 317 - DNA, 29 bp, Artificial Sequence
  Synthetic oligonucleotide
actttacagtttatgctgatgaagaatac

SEQ ID NO: 318 - DNA, 29 bp, Artificial Sequence
  Synthetic oligonucleotide
actttacagtttatgctgatgaagatgtt

SEQ ID NO: 319 - DNA, 29 bp, Artificial Sequence
  Synthetic oligonucleotide
actttacagtttatgctgatgaagatgac

SEQ ID NO: 320 - DNA, 29 bp, Artificial Sequence
  Synthetic oligonucleotide
actttacggtttatgctgatgaagatgac

SEQ ID NO: 321 - DNA, 29 bp, Artificial Sequence
  Synthetic oligonucleotide
actttacagtttatgctgatgaagatgac

SEQ ID NO: 322 - DNA, 29 bp, Artificial Sequence
  Synthetic oligonucleotide
actttacagtttatgctgatgaagatgcc

SEQ ID NO: 323 - DNA, 34 bp, Artificial Sequence
  Synthetic oligonucleotide
actttacagtttatgctatgctgatgaagatgac

SEQ ID NO: 324 - DNA, 34 bp, Artificial Sequence
  Synthetic oligonucleotide
gctttacagtttatgctatgctgatgaagatgac

SEQ ID NO: 325 - DNA, 34 bp, Artificial Sequence
  Synthetic oligonucleotide
actttacggtttatgctatgctgatgaagatgac

SEQ ID NO: 326 - DNA, 34 bp, Artificial Sequence
  Synthetic oligonucleotide
actttacagtttatgctatgctgatgatgatgac

SEQ ID NO: 327 - DNA, 34 bp, Artificial Sequence
  Synthetic oligonucleotide
acgttacagtttatgctatgctgatgaagatgac

SEQ ID NO: 328 - DNA, 29 bp, Artificial Sequence
  Synthetic oligonucleotide
actttacagtttatgctgatgaagatgac

SEQ ID NO: 329 - DNA, 29 bp, Artificial Sequence
  Synthetic oligonucleotide
actttacagtttatgctgatgaagatgtc

SEQ ID NO: 330 - DNA, 30 bp, Artificial Sequence; identical to SEQ ID NO: 288
  Synthetic oligonucleotide

SEQ ID NO: 331 - DNA, 34 bp, Artificial Sequence
  Synthetic oligonucleotide
gttatcctcagcaaactaactaaaactggaacag

SEQ ID NO: 332 - DNA, 30 bp, Artificial Sequence; identical to SEQ ID NO: 288
  Synthetic oligonucleotide

SEQ ID NO: 333 - DNA, 30 bp, Artificial Sequence
  Synthetic oligonucleotide
gttatcctcagcaaactaaaactgggacag

SEQ ID NO: 334 - DNA, 30 bp, Artificial Sequence
  Synthetic oligonucleotide
gttatcctcagcaaactaaaactggaccag

SEQ ID NO: 335 - DNA, 30 bp, Artificial Sequence
  Synthetic oligonucleotide
gttatactcagcaaactaaaactggaacag

SEQ ID NO: 336 - DNA, 30 bp, Artificial Sequence; identical to SEQ ID NO: 288
  Synthetic oligonucleotide

SEQ ID NO: 337 - DNA, 30 bp, Artificial Sequence
  Synthetic oligonucleotide
attatcctcagcaaactaaaactggaacag

SEQ ID NO: 338 - DNA, 30 bp, Artificial Sequence
  Synthetic oligonucleotide
gttatccttagcaaactaaaactggaacag

SEQ ID NO: 339 - DNA, 30 bp, Artificial Sequence; identical to SEQ ID NO: 288
  Synthetic oligonucleotide

SEQ ID NO: 340 - DNA, 30 bp, Artificial Sequence
  Synthetic oligonucleotide
gatatcctcagcaaactaaaactggaacag

SEQ ID NO: 341 - DNA, 29 bp, Artificial Sequence
  Synthetic oligonucleotide
ctttttcagtttcttttgctgagcaggac

SEQ ID NO: 342 - DNA, 29 bp, Artificial Sequence
  Synthetic oligonucleotide
ctttttcagtttcttttgctgagcaggac

SEQ ID NO: 343 - DNA, 29 bp, Artificial Sequence
  Synthetic oligonucleotide
catttgcagtttcgggagatgaggaacat

SEQ ID NO: 344 - DNA, 31 bp, Artificial Sequence
  Synthetic oligonucleotide
catttgcagtttcgggagagatgaggaacat

SEQ ID NO: 345 - DNA, 31 bp, Artificial Sequence
  Synthetic oligonucleotide
catttgcagttacgggagagatgaggaacat

SEQ ID NO: 346 - DNA, 31 bp, Artificial Sequence
  Synthetic oligonucleotide
catttgcagtttcgggagagatgagggacat

SEQ ID NO: 347 - DNA, 31 bp, Artificial Sequence
  Synthetic oligonucleotide
catttgacgcttcgggagaggtgagggacat

SEQ ID NO: 348 - DNA, 33 bp, Artificial Sequence
  Synthetic oligonucleotide
catttgcagtttcgggcgggagatgaggaacat

SEQ ID NO: 349 - DNA, 33 bp, Artificial Sequence
  Synthetic oligonucleotide
catttgcagtttcgggcgggagatgcggaacat

SEQ ID NO: 350 - DNA, 33 bp, Artificial Sequence
  Synthetic oligonucleotide
catttgcagtttcgggcgggcgatgaggaacat

SEQ ID NO: 351 - DNA, 33 bp, Artificial Sequence
  Synthetic oligonucleotide
catttgcagtttcgggcgggaggtgaggaacat

SEQ ID NO: 352 - DNA, 33 bp, Artificial Sequence
  Synthetic oligonucleotide
cgtttgcagtttcgggcgggagatgaggaacat

SEQ ID NO: 353 - DNA, 33 bp, Artificial Sequence
  Synthetic oligonucleotide
catttgctgtttcgggcgggagatgaggaacat

SEQ ID NO: 354 - DNA, 33 bp, Artificial Sequence
  Synthetic oligonucleotide
catttgcagtttcgggcgggagatgaggaccat

SEQ ID NO: 355 - DNA, 33 bp, Artificial Sequence; identical to SEQ ID NO: 351
  Synthetic oligonucleotide

SEQ ID NO: 356 - DNA, 33 bp, Artificial Sequence
  Synthetic oligonucleotide
cctttgcagtttcgggcgggagatgaggaacat

SEQ ID NO: 357 - DNA, 33 bp, Artificial Sequence
  Synthetic oligonucleotide
catttgcagttgcgggcgggagatgaggaacat

SEQ ID NO: 358 - DNA, 29 bp, Artificial Sequence
  Synthetic oligonucleotide
gtcttcctgatgctaccaaactggaaaag

SEQ ID NO: 359 - DNA, 29 bp, Artificial Sequence
  Synthetic oligonucleotide
gtcttcctgatgctaccaaactggaaaag

SEQ ID NO: 360 - DNA, 29 bp, Artificial Sequence
  Synthetic oligonucleotide
gtcttcctgatgctaccaaacttgaaaag

SEQ ID NO: 361 - DNA, 29 bp, Artificial Sequence
  Synthetic oligonucleotide
gtcttcatgatgctaccaaactggaaaag

SEQ ID NO: 362 - DNA, 30 bp, Artificial Sequence
  Synthetic oligonucleotide
cttttgcagtctgtaggtgttgaggttgac

SEQ ID NO: 363 - DNA, 30 bp, Artificial Sequence; identical to SEQ ID NO: 362
  Synthetic oligonucleotide

SEQ ID NO: 364 - DNA, 30 bp, Artificial Sequence; identical to SEQ ID NO: 362
  Synthetic oligonucleotide

SEQ ID NO: 365 - DNA, 30 bp, Artificial Sequence; identical to SEQ ID NO: 362
  Synthetic oligonucleotide

SEQ ID NO: 366 - DNA, 9 bp, Artificial Sequence
  Synthetic oligonucleotide
agcagcgtc

SEQ ID NO: 367 - DNA, 9 bp, Artificial Sequence
  Synthetic oligonucleotide
agcagcgtc

SEQ ID NO: 368 - DNA, 9 bp, Artificial Sequence
  Synthetic oligonucleotide
agcagcctc

SEQ ID NO: 369 - DNA, 9 bp, Artificial Sequence
  Synthetic oligonucleotide
agcagcgtt

SEQ ID NO: 370 - DNA, 9 bp, Artificial Sequence
  Synthetic oligonucleotide
agcagcgtc

SEQ ID NO: 371 - DNA, 9 bp, Artificial Sequence
  Synthetic oligonucleotide
agcagcgtc

SEQ ID NO: 372 - DNA, 9 bp, Artificial Sequence
  Synthetic oligonucleotide
agcagcgtc

SEQ ID NO: 373 - DNA, 9 bp, Artificial Sequence
  Synthetic oligonucleotide
agcagcgtc

SEQ ID NO: 374 - DNA, 9 bp, Artificial Sequence
  Synthetic oligonucleotide
agcagcgtc

SEQ ID NO: 375 - DNA, 9 bp, Artificial Sequence
  Synthetic oligonucleotide
agcagcgtc

SEQ ID NO: 376 - DNA, 9 bp, Artificial Sequence
  Synthetic oligonucleotide
agcagcgtc

SEQ ID NO: 377 - DNA, 9 bp, Artificial Sequence
  Synthetic oligonucleotide
agcagcgtc

SEQ ID NO: 378 - DNA, 9 bp, Artificial Sequence
  Synthetic oligonucleotide
agaagcgtc

SEQ ID NO: 379 - DNA, 9 bp, Artificial Sequence
  Synthetic oligonucleotide
agcaacgtc

SEQ ID NO: 380 - DNA, 9 bp, Artificial Sequence
  Synthetic oligonucleotide
agcaacgtc

SEQ ID NO: 381 - DNA, 9 bp, Artificial Sequence
  Synthetic oligonucleotide
agcaacgtc

SEQ ID NO: 382 - DNA, 9 bp, Artificial Sequence
  Synthetic oligonucleotide
agcaccgtc

SEQ ID NO: 383 - DNA, 9 bp, Artificial Sequence
  Synthetic oligonucleotide
agcagagtc

SEQ ID NO: 384 - DNA, 9 bp, Artificial Sequence
  Synthetic oligonucleotide
agcagagtc

SEQ ID NO: 385 - DNA, 9 bp, Artificial Sequence
  Synthetic oligonucleotide
agcagcatc

SEQ ID NO: 386 - DNA, 9 bp, Artificial Sequence
  Synthetic oligonucleotide
agcagcctc

SEQ ID NO: 387 - DNA, 9 bp, Artificial Sequence
  Synthetic oligonucleotide
agcagcctc

SEQ ID NO: 388 - DNA, 9 bp, Artificial Sequence
  Synthetic oligonucleotide
agcagcgac

SEQ ID NO: 389 - DNA, 9 bp, Artificial Sequence
  Synthetic oligonucleotide
agcagcgtg

SEQ ID NO: 390 - DNA, 9 bp, Artificial Sequence
  Synthetic oligonucleotide
agcagcttc

SEQ ID NO: 391 - DNA, 9 bp, Artificial Sequence
  Synthetic oligonucleotide
agcagcttc

SEQ ID NO: 392 - DNA, 9 bp, Artificial Sequence
  Synthetic oligonucleotide
agcagcttc

SEQ ID NO: 393 - DNA, 9 bp, Artificial Sequence
  Synthetic oligonucleotide
agcagggtc

SEQ ID NO: 394 - DNA, 9 bp, Artificial Sequence
  Synthetic oligonucleotide
agcagtgtc

SEQ ID NO: 395 - DNA, 9 bp, Artificial Sequence
  Synthetic oligonucleotide
agcagtgtc

SEQ ID NO: 396 - DNA, 9 bp, Artificial Sequence
  Synthetic oligonucleotide
agcagtgtc

SEQ ID NO: 397 - DNA, 9 bp, Artificial Sequence
  Synthetic oligonucleotide
agcagtgtc

SEQ ID NO: 398 - DNA, 9 bp, Artificial Sequence
  Synthetic oligonucleotide
agcagtgtc

SEQ ID NO: 399 - DNA, 9 bp, Artificial Sequence
  Synthetic oligonucleotide
agcagtgtc

SEQ ID NO: 400 - DNA, 9 bp, Artificial Sequence
  Synthetic oligonucleotide
agcatcgtc

SEQ ID NO: 401 - DNA, 9 bp, Artificial Sequence
  Synthetic oligonucleotide
agcatcgtc

SEQ ID NO: 402 - DNA, 9 bp, Artificial Sequence
  Synthetic oligonucleotide
agcatcgtc

SEQ ID NO: 403 - DNA, 9 bp, Artificial Sequence
  Synthetic oligonucleotide
aggagcgtc

SEQ ID NO: 404 - DNA, 9 bp, Artificial Sequence
  Synthetic oligonucleotide
aacagcttc

SEQ ID NO: 405 - DNA, 9 bp, Artificial Sequence
  Synthetic oligonucleotide
aacagcttc

SEQ ID NO: 406 - DNA, 9 bp, Artificial Sequence
  Synthetic oligonucleotide
aacagcttc

SEQ ID NO: 407 - DNA, 9 bp, Artificial Sequence
  Synthetic oligonucleotide
agcaaagtc

SEQ ID NO: 408 - DNA, 9 bp, Artificial Sequence
  Synthetic oligonucleotide
agcaacttc

SEQ ID NO: 409 - DNA, 9 bp, Artificial Sequence
  Synthetic oligonucleotide
agcaccttc

SEQ ID NO: 410 - DNA, 9 bp, Artificial Sequence
  Synthetic oligonucleotide
agcagcata

SEQ ID NO: 411 - DNA, 9 bp, Artificial Sequence
  Synthetic oligonucleotide
agcagcata

SEQ ID NO: 412 - DNA, 9 bp, Artificial Sequence
  Synthetic oligonucleotide
agcagcata

SEQ ID NO: 413 - DNA, 9 bp, Artificial Sequence
  Synthetic oligonucleotide
agcagcgag

SEQ ID NO: 414 - DNA, 9 bp, Artificial Sequence
  Synthetic oligonucleotide
agcagcggt

SEQ ID NO: 415 - DNA, 9 bp, Artificial Sequence
  Synthetic oligonucleotide
agcagggtt

SEQ ID NO: 416 - DNA, 9 bp, Artificial Sequence
  Synthetic oligonucleotide
agctgagtc

SEQ ID NO: 417 - DNA, 9 bp, Artificial Sequence
  Synthetic oligonucleotide
agctgagtc

SEQ ID NO: 418 - DNA, 9 bp, Artificial Sequence
  Synthetic oligonucleotide
agctgggtc

SEQ ID NO: 419 - DNA, 9 bp, Artificial Sequence
  Synthetic oligonucleotide
agctgggtc

SEQ ID NO: 420 - DNA, 9 bp, Artificial Sequence
  Synthetic oligonucleotide
agctgtgtc

SEQ ID NO: 421 - DNA, 9 bp, Artificial Sequence
  Synthetic oligonucleotide
agctgtgtc

SEQ ID NO: 422 - DNA, 9 bp, Artificial Sequence
  Synthetic oligonucleotide
agtagcggc

SEQ ID NO: 423 - DNA, 9 bp, Artificial Sequence
  Synthetic oligonucleotide
agtggcgtc

SEQ ID NO: 424 - DNA, 9 bp, Artificial Sequence
  Synthetic oligonucleotide
ggcagagtc

SEQ ID NO: 425 - DNA, 9 bp, Artificial Sequence
  Synthetic oligonucleotide
tccagcgtc

SEQ ID NO: 426 - DNA, 9 bp, Artificial Sequence
  Synthetic oligonucleotide
tgcagcggc

SEQ ID NO: 427 - DNA, 9 bp, Artificial Sequence
  Synthetic oligonucleotide
tgcagcgtt

SEQ ID NO: 428 - DNA, 9 bp, Artificial Sequence
  Synthetic oligonucleotide
tgcagggtc

SEQ ID NO: 429 - DNA, 9 bp, Artificial Sequence
  Synthetic oligonucleotide
tgcagtgtc

SEQ ID NO: 430 - DNA, 9 bp, Artificial Sequence
  Synthetic oligonucleotide
agcaacgtc

SEQ ID NO: 431 - DNA, 9 bp, Artificial Sequence
  Synthetic oligonucleotide
agcaacgtc

SEQ ID NO: 432 - DNA, 9 bp, Artificial Sequence
  Synthetic oligonucleotide
agcaccgtc

SEQ ID NO: 433 - DNA, 9 bp, Artificial Sequence
  Synthetic oligonucleotide
agcagcggc

SEQ ID NO: 434 - DNA, 9 bp, Artificial Sequence
  Synthetic oligonucleotide
agcagcggc

SEQ ID NO: 435 - DNA, 9 bp, Artificial Sequence
  Synthetic oligonucleotide
agcagtgtc

SEQ ID NO: 436 - DNA, 9 bp, Artificial Sequence
  Synthetic oligonucleotide
agaaacgtc

SEQ ID NO: 437 - DNA, 9 bp, Artificial Sequence
  Synthetic oligonucleotide
agcaaagtc

SEQ ID NO: 438 - DNA, 9 bp, Artificial Sequence
  Synthetic oligonucleotide
agcaacatc

SEQ ID NO: 439 - DNA, 9 bp, Artificial Sequence
  Synthetic oligonucleotide
agcaacatc

SEQ ID NO: 440 - DNA, 9 bp, Artificial Sequence
  Synthetic oligonucleotide
agcaacttc

SEQ ID NO: 441 - DNA, 9 bp, Artificial Sequence
  Synthetic oligonucleotide
agcaacttc

SEQ ID NO: 442 - DNA, 9 bp, Artificial Sequence
  Synthetic oligonucleotide
agcaatgtc

SEQ ID NO: 443 - DNA, 9 bp, Artificial Sequence
  Synthetic oligonucleotide
agcaccgtg

SEQ ID NO: 444 - DNA, 9 bp, Artificial Sequence
  Synthetic oligonucleotide
agcacggtc

SEQ ID NO: 445 - DNA, 9 bp, Artificial Sequence
  Synthetic oligonucleotide
agcagcagc

SEQ ID NO: 446 - DNA, 9 bp, Artificial Sequence
  Synthetic oligonucleotide
agcagcagc

SEQ ID NO: 447 - DNA, 9 bp, Artificial Sequence
  Synthetic oligonucleotide
agcagctcc

SEQ ID NO: 448 - DNA, 9 bp, Artificial Sequence
  Synthetic oligonucleotide
agcagggtg

SEQ ID NO: 449 - DNA, 9 bp, Artificial Sequence
  Synthetic oligonucleotide
agcatagtc

SEQ ID NO: 450 - DNA, 9 bp, Artificial Sequence
  Synthetic oligonucleotide
agcatggtc

SEQ ID NO: 451 - DNA, 9 bp, Artificial Sequence
  Synthetic oligonucleotide
agcattgtc

SEQ ID NO: 452 - DNA, 9 bp, Artificial Sequence
  Synthetic oligonucleotide
agcattgtc

SEQ ID NO: 453 - DNA, 9 bp, Artificial Sequence
  Synthetic oligonucleotide
agtagcgtt

SEQ ID NO: 454 - DNA, 9 bp, Artificial Sequence
  Synthetic oligonucleotide
atcagagtc

SEQ ID NO: 455 - DNA, 9 bp, Artificial Sequence
  Synthetic oligonucleotide
atcagtgtc

SEQ ID NO: 456 - DNA, 9 bp, Artificial Sequence
  Synthetic oligonucleotide
ggcagagtc

SEQ ID NO: 457 - DNA, 9 bp, Artificial Sequence
  Synthetic oligonucleotide
ggcagcggc

SEQ ID NO: 458 - DNA, 9 bp, Artificial Sequence
  Synthetic oligonucleotide
tgcagcttc

SEQ ID NO: 459 - DNA, 9 bp, Artificial Sequence
  Synthetic oligonucleotide
agcatagtt

SEQ ID NO: 460 - DNA, 9 bp, Artificial Sequence
  Synthetic oligonucleotide
agtaaagtc

SEQ ID NO: 461 - DNA, 9 bp, Artificial Sequence
  Synthetic oligonucleotide
tgcagtctc

SEQ ID NO: 462 - DNA, 9 bp, Artificial Sequence
  Synthetic oligonucleotide
gagtgagga

SEQ ID NO: 463 - DNA, 9 bp, Artificial Sequence
  Synthetic oligonucleotide
gagtgaaga

SEQ ID NO: 464 - DNA, 9 bp, Artificial Sequence
  Synthetic oligonucleotide
gagtgagga

SEQ ID NO: 465 - DNA, 9 bp, Artificial Sequence
  Synthetic oligonucleotide
gagtgagga

SEQ ID NO: 466 - DNA, 9 bp, Artificial Sequence
  Synthetic oligonucleotide
cagtgagca

SEQ ID NO: 467 - DNA, 9 bp, Artificial Sequence
  Synthetic oligonucleotide
gtgtgaggt

SEQ ID NO: 468 - DNA, 9 bp, Artificial Sequence
  Synthetic oligonucleotide
aagtgggga

SEQ ID NO: 469 - DNA, 9 bp, Artificial Sequence
  Synthetic oligonucleotide
gagggaaga

SEQ ID NO: 470 - DNA, 9 bp, Artificial Sequence
  Synthetic oligonucleotide
gagggaggg

SEQ ID NO: 471 - DNA, 9 bp, Artificial Sequence
  Synthetic oligonucleotide
gagtgtgca

SEQ ID NO: 472 - DNA, 9 bp, Artificial Sequence
  Synthetic oligonucleotide
gagtgatgg

SEQ ID NO: 473 - DNA, 9 bp, Artificial Sequence
  Synthetic oligonucleotide
gagtgaaaa

SEQ ID NO: 474 - DNA, 9 bp, Artificial Sequence
  Synthetic oligonucleotide
gagtgaggt

SEQ ID NO: 475 - DNA, 9 bp, Artificial Sequence
  Synthetic oligonucleotide
gggtgagga

SEQ ID NO: 476 - DNA, 9 bp, Artificial Sequence
  Synthetic oligonucleotide
cagtgagga

SEQ ID NO: 477 - DNA, 9 bp, Artificial Sequence
  Synthetic oligonucleotide
gattgagga

SEQ ID NO: 478 - DNA, 9 bp, Artificial Sequence
  Synthetic oligonucleotide
tagtgagga

SEQ ID NO: 479 - DNA, 9 bp, Artificial Sequence
  Synthetic oligonucleotide
gagtgaggt

SEQ ID NO: 480 - DNA, 9 bp, Artificial Sequence
  Synthetic oligonucleotide
gagtgaggc

SEQ ID NO: 481 - DNA, 9 bp, Artificial Sequence
  Synthetic oligonucleotide
gagtgaggc

SEQ ID NO: 482 - DNA, 9 bp, Artificial Sequence
  Synthetic oligonucleotide
gagtgaggc

SEQ ID NO: 483 - DNA, 9 bp, Artificial Sequence
  Synthetic oligonucleotide
gagtgaggt

SEQ ID NO: 484 - DNA, 9 bp, Artificial Sequence
  Synthetic oligonucleotide
gagtgaggt

SEQ ID NO: 485 - DNA, 9 bp, Artificial Sequence
  Synthetic oligonucleotide
gagtgaggc

SEQ ID NO: 486 - DNA, 9 bp, Artificial Sequence
  Synthetic oligonucleotide
gtgtgagga

SEQ ID NO: 487 - DNA, 9 bp, Artificial Sequence
  Synthetic oligonucleotide
gagtgagaa

SEQ ID NO: 488 - DNA, 9 bp, Artificial Sequence
  Synthetic oligonucleotide
gagtgaggg

SEQ ID NO: 489 - DNA, 9 bp, Artificial Sequence
  Synthetic oligonucleotide
gagtgaggc

SEQ ID NO: 490 - DNA, 9 bp, Artificial Sequence
  Synthetic oligonucleotide
gtgtgagga

SEQ ID NO: 491 - DNA, 9 bp, Artificial Sequence
  Synthetic oligonucleotide
gtgtgagga

SEQ ID NO: 492 - DNA, 9 bp, Artificial Sequence
  Synthetic oligonucleotide
gtgtgagga

SEQ ID NO: 493 - DNA, 9 bp, Artificial Sequence
  Synthetic oligonucleotide
gtgtgagga

SEQ ID NO: 494 - DNA, 9 bp, Artificial Sequence
  Synthetic oligonucleotide
gtgtgagga

SEQ ID NO: 495 - DNA, 9 bp, Artificial Sequence
  Synthetic oligonucleotide
gggtgagga

SEQ ID NO: 496 - DNA, 9 bp, Artificial Sequence
  Synthetic oligonucleotide
cagtgagga

SEQ ID NO: 497 - DNA, 9 bp, Artificial Sequence
  Synthetic oligonucleotide
gagtgaggc

SEQ ID NO: 498 - DNA, 9 bp, Artificial Sequence
  Synthetic oligonucleotide
gagtgagta

SEQ ID NO: 499 - DNA, 9 bp, Artificial Sequence
  Synthetic oligonucleotide
gagtgaggc

SEQ ID NO: 500 - DNA, 9 bp, Artificial Sequence
  Synthetic oligonucleotide
gagtgagga

SEQ ID NO: 501 - DNA, 9 bp, Artificial Sequence
  Synthetic oligonucleotide
gagtgagga

SEQ ID NO: 502 - DNA, 9 bp, Artificial Sequence
  Synthetic oligonucleotide
gagtgagga

SEQ ID NO: 503 - DNA, 9 bp, Artificial Sequence
  Synthetic oligonucleotide
gagtgagga

SEQ ID NO: 504 - DNA, 9 bp, Artificial Sequence
  Synthetic oligonucleotide
gagtgagga

SEQ ID NO: 505 - DNA, 9 bp, Artificial Sequence
  Synthetic oligonucleotide
gagtgagga

SEQ ID NO: 506 - DNA, 9 bp, Artificial Sequence
  Synthetic oligonucleotide
gagtgagga

SEQ ID NO: 507 - DNA, 9 bp, Artificial Sequence
  Synthetic oligonucleotide
gagtgagga

SEQ ID NO: 508 - DNA, 9 bp, Artificial Sequence
  Synthetic oligonucleotide
gagtgagga

SEQ ID NO: 509 - DNA, 9 bp, Artificial Sequence
  Synthetic oligonucleotide
gagtgagga

SEQ ID NO: 510 - DNA, 9 bp, Artificial Sequence
  Synthetic oligonucleotide
gagtgagga

SEQ ID NO: 511 - DNA, 9 bp, Artificial Sequence
  Synthetic oligonucleotide
gagtgagga

SEQ ID NO: 512 - DNA, 9 bp, Artificial Sequence
  Synthetic oligonucleotide
gagtgagga

SEQ ID NO: 513 - DNA, 9 bp, Artificial Sequence
  Synthetic oligonucleotide
gagtgagga

SEQ ID NO: 514 - DNA, 9 bp, Artificial Sequence
  Synthetic oligonucleotide
gagtgagga

SEQ ID NO: 515 - DNA, 9 bp, Artificial Sequence
  Synthetic oligonucleotide
gagtgagga

SEQ ID NO: 516 - DNA, 9 bp, Artificial Sequence
  Synthetic oligonucleotide
gagtgagga

SEQ ID NO: 517 - DNA, 9 bp, Artificial Sequence
  Synthetic oligonucleotide
gagtgagga

SEQ ID NO: 518 - DNA, 9 bp, Artificial Sequence
  Synthetic oligonucleotide
gagtgagga

SEQ ID NO: 519 - DNA, 9 bp, Artificial Sequence
  Synthetic oligonucleotide
gagtgagga

SEQ ID NO: 520 - DNA, 9 bp, Artificial Sequence
  Synthetic oligonucleotide
gagtgagga

SEQ ID NO: 521 - DNA, 9 bp, Artificial Sequence
  Synthetic oligonucleotide
gagtgagga

SEQ ID NO: 522 - DNA, 9 bp, Artificial Sequence
  Synthetic oligonucleotide
gagtgagga

SEQ ID NO: 523 - DNA, 9 bp, Artificial Sequence
  Synthetic oligonucleotide
gagtgagga

SEQ ID NO: 524 - DNA, 9 bp, Artificial Sequence
  Synthetic oligonucleotide
gagtgagga

SEQ ID NO: 525 - DNA, 9 bp, Artificial Sequence
  Synthetic oligonucleotide
gagtgagga

SEQ ID NO: 526 - DNA, 9 bp, Artificial Sequence
  Synthetic oligonucleotide
gtgtgagaa

SEQ ID NO: 527 - DNA, 9 bp, Artificial Sequence
  Synthetic oligonucleotide
gagtgttga

SEQ ID NO: 528 - DNA, 9 bp, Artificial Sequence
  Synthetic oligonucleotide
cagtgaggc

SEQ ID NO: 529 - DNA, 9 bp, Artificial Sequence
  Synthetic oligonucleotide
cagtgaggc

SEQ ID NO: 530 - DNA, 9 bp, Artificial Sequence
  Synthetic oligonucleotide
gggtgaggt

SEQ ID NO: 531 - DNA, 9 bp, Artificial Sequence
  Synthetic oligonucleotide
gagtgagat

SEQ ID NO: 532 - DNA, 9 bp, Artificial Sequence
  Synthetic oligonucleotide
gagtgaggg

SEQ ID NO: 533 - DNA, 9 bp, Artificial Sequence
  Synthetic oligonucleotide
gagtgaggg

SEQ ID NO: 534 - DNA, 9 bp, Artificial Sequence
  Synthetic oligonucleotide
gagtgaggg

SEQ ID NO: 535 - DNA, 9 bp, Artificial Sequence
  Synthetic oligonucleotide
gagtgaggg

SEQ ID NO: 536 - DNA, 9 bp, Artificial Sequence
  Synthetic oligonucleotide
gagtgaggg

SEQ ID NO: 537 - DNA, 9 bp, Artificial Sequence
  Synthetic oligonucleotide
gagtgaggg

SEQ ID NO: 538 - DNA, 9 bp, Artificial Sequence
  Synthetic oligonucleotide
gagtgaggc

SEQ ID NO: 539 - DNA, 9 bp, Artificial Sequence
  Synthetic oligonucleotide
gagtgaggc

SEQ ID NO: 540 - DNA, 9 bp, Artificial Sequence
  Synthetic oligonucleotide
gagtgaggc

SEQ ID NO: 541 - DNA, 9 bp, Artificial Sequence
  Synthetic oligonucleotide
gagtgaggg

SEQ ID NO: 542 - DNA, 9 bp, Artificial Sequence
  Synthetic oligonucleotide
gagtgaggg

SEQ ID NO: 543 - DNA, 9 bp, Artificial Sequence
  Synthetic oligonucleotide
gagtgaggt

SEQ ID NO: 544 - DNA, 9 bp, Artificial Sequence
  Synthetic oligonucleotide
gagtgaggc

SEQ ID NO: 545 - DNA, 9 bp, Artificial Sequence
  Synthetic oligonucleotide
gagtgaggc

SEQ ID NO: 546 - DNA, 9 bp, Artificial Sequence
  Synthetic oligonucleotide
gagtgaggg

SEQ ID NO: 547 - DNA, 9 bp, Artificial Sequence
  Synthetic oligonucleotide
gagtgaggt

SEQ ID NO: 548 - DNA, 9 bp, Artificial Sequence
  Synthetic oligonucleotide
gagtgaggg

SEQ ID NO: 549 - DNA, 9 bp, Artificial Sequence
  Synthetic oligonucleotide
gagtgaggt

SEQ ID NO: 550 - DNA, 9 bp, Artificial Sequence
  Synthetic oligonucleotide
gagtgaggc

SEQ ID NO: 551 - DNA, 9 bp, Artificial Sequence
  Synthetic oligonucleotide
gagtgaggc

SEQ ID NO: 552 - DNA, 9 bp, Artificial Sequence
  Synthetic oligonucleotide
gagtgaggc

SEQ ID NO: 553 - DNA, 9 bp, Artificial Sequence
  Synthetic oligonucleotide
gagtgaggt

SEQ ID NO: 554 - DNA, 9 bp, Artificial Sequence
  Synthetic oligonucleotide
gagtgaggc

SEQ ID NO: 555 - DNA, 9 bp, Artificial Sequence
  Synthetic oligonucleotide
gagtgagga

SEQ ID NO: 556 - DNA, 9 bp, Artificial Sequence
  Synthetic oligonucleotide
gagtgagga

SEQ ID NO: 557 - DNA, 9 bp, Artificial Sequence
  Synthetic oligonucleotide
gagtgaggt

SEQ ID NO: 558 - DNA, 23 bp, Artificial Sequence
  Synthetic oligonucleotide
agcagcgtcttcgagagtgagga

SEQ ID NO: 559 - DNA, 23 bp, Artificial Sequence
  Synthetic oligonucleotide
agcagcgtcaatacgagtgaaga

SEQ ID NO: 560 - DNA, 23 bp, Artificial Sequence
  Synthetic oligonucleotide
agcagcctctgcttgagtgagga

SEQ ID NO: 561 - DNA, 23 bp, Artificial Sequence
  Synthetic oligonucleotide
agcagcgttgggaggagtgagga

SEQ ID NO: 562 - DNA, 23 bp, Artificial Sequence
  Synthetic oligonucleotide
agcagcgtcaaaaacagtgagca

SEQ ID NO: 563 - DNA, 23 bp, Artificial Sequence
  Synthetic oligonucleotide
agcagcgtcgtgtggtgtgaggt

SEQ ID NO: 564 - DNA, 24 bp, Artificial Sequence
  Synthetic oligonucleotide
agcagcgtcgttctcaagtgggga

SEQ ID NO: 565 - DNA, 24 bp, Artificial Sequence
  Synthetic oligonucleotide
agcagcgtctaggcagagggaaga

SEQ ID NO: 566 - DNA, 24 bp, Artificial Sequence
  Synthetic oligonucleotide
agcagcgtctagggggagggaggg

SEQ ID NO: 567 - DNA, 24 bp, Artificial Sequence
  Synthetic oligonucleotide
agcagcgtctcaaaagagtgtgca

SEQ ID NO: 568 - DNA, 24 bp, Artificial Sequence
  Synthetic oligonucleotide
agcagcgtctcccttgagtgatgg

SEQ ID NO: 569 - DNA, 23 bp, Artificial Sequence
  Synthetic oligonucleotide
agcagcgtctgaaagagtgaaaa

SEQ ID NO: 570 - DNA, 23 bp, Artificial Sequence
  Synthetic oligonucleotide
agaagcgtcatcgagagtgaggt

SEQ ID NO: 571 - DNA, 24 bp, Artificial Sequence
  Synthetic oligonucleotide
agcaacgtcagataggggtgagga

SEQ ID NO: 572 - DNA, 23 bp, Artificial Sequence
  Synthetic oligonucleotide
agcaacgtcatattcagtgagga

SEQ ID NO: 573 - DNA, 23 bp, Artificial Sequence
  Synthetic oligonucleotide
agcaacgtcgtagtgattgagga

SEQ ID NO: 574 - DNA, 23 bp, Artificial Sequence
  Synthetic oligonucleotide
agcaccgtcttttctagtgagga

SEQ ID NO: 575 - DNA, 24 bp, Artificial Sequence
  Synthetic oligonucleotide
agcagagtcagacttgagtgaggt

SEQ ID NO: 576 - DNA, 23 bp, Artificial Sequence
  Synthetic oligonucleotide
agcagagtctctgagagtgaggc

SEQ ID NO: 577 - DNA, 23 bp, Artificial Sequence
  Synthetic oligonucleotide
agcagcatcagtgagagtgaggc

SEQ ID NO: 578 - DNA, 24 bp, Artificial Sequence
  Synthetic oligonucleotide
agcagcctctccaaagagtgaggc

SEQ ID NO: 579 - DNA, 24 bp, Artificial Sequence
  Synthetic oligonucleotide
agcagcctctgcatcgagtgaggt

SEQ ID NO: 580 - DNA, 24 bp, Artificial Sequence
  Synthetic oligonucleotide
agcagcgacgcctgggagtgaggt

SEQ ID NO: 581 - DNA, 23 bp, Artificial Sequence
  Synthetic oligonucleotide
agcagcgtgcccaagagtgaggc

SEQ ID NO: 582 - DNA, 24 bp, Artificial Sequence
  Synthetic oligonucleotide
agcagcttcaggggagtgtgagga

SEQ ID NO: 583 - DNA, 23 bp, Artificial Sequence
  Synthetic oligonucleotide
agcagcttccttttgagtgagaa

SEQ ID NO: 584 - DNA, 24 bp, Artificial Sequence
  Synthetic oligonucleotide
agcagcttctcctgggagtgaggg

SEQ ID NO: 585 - DNA, 24 bp, Artificial Sequence
  Synthetic oligonucleotide
agcagggtcagggctgagtgaggc

SEQ ID NO: 586 - DNA, 24 bp, Artificial Sequence
  Synthetic oligonucleotide
agcagtgtcaggctggtgtgagga

SEQ ID NO: 587 - DNA, 24 bp, Artificial Sequence
  Synthetic oligonucleotide
agcagtgtcaggctggtgtgagga

SEQ ID NO: 588 - DNA, 24 bp, Artificial Sequence
  Synthetic oligonucleotide
agcagtgtcaggctggtgtgagga

SEQ ID NO: 589 - DNA, 24 bp, Artificial Sequence
  Synthetic oligonucleotide
agcagtgtcaggctggtgtgagga

SEQ ID NO: 590 - DNA, 24 bp, Artificial Sequence
  Synthetic oligonucleotide
agcagtgtcaggctggtgtgagga

SEQ ID NO: 591 - DNA, 24 bp, Artificial Sequence
  Synthetic oligonucleotide
agcagtgtcctaagggggtgagga

SEQ ID NO: 592 - DNA, 24 bp, Artificial Sequence
  Synthetic oligonucleotide
agcatcgtcatcagacagtgagga

SEQ ID NO: 593 - DNA, 24 bp, Artificial Sequence
  Synthetic oligonucleotide
agcatcgtctgaagtgagtgaggc

SEQ ID NO: 594 - DNA, 24 bp, Artificial Sequence
  Synthetic oligonucleotide
agcatcgtcttctgtgagtgagta

SEQ ID NO: 595 - DNA, 24 bp, Artificial Sequence
  Synthetic oligonucleotide
aggagcgtctcacctgagtgaggc

SEQ ID NO: 596 - DNA, 24 bp, Artificial Sequence
  Synthetic oligonucleotide
aacagcttcatctcggagtgagga

SEQ ID NO: 597 - DNA, 24 bp, Artificial Sequence
  Synthetic oligonucleotide
aacagcttctcgggagagtgagga

SEQ ID NO: 598 - DNA, 24 bp, Artificial Sequence
  Synthetic oligonucleotide
aacagcttctctgaggagtgagga

SEQ ID NO: 599 - DNA, 23 bp, Artificial Sequence
  Synthetic oligonucleotide
agcaaagtcaaacagagtgagga

SEQ ID NO: 600 - DNA, 24 bp, Artificial Sequence
  Synthetic oligonucleotide
agcaacttctggaaagagtgagga

SEQ ID NO: 601 - DNA, 23 bp, Artificial Sequence
  Synthetic oligonucleotide
agcaccttcaattggagtgagga

SEQ ID NO: 602 - DNA, 24 bp, Artificial Sequence
  Synthetic oligonucleotide
agcagcataatagcagagtgagga

SEQ ID NO: 603 - DNA, 24 bp, Artificial Sequence
  Synthetic oligonucleotide
agcagcatagatatggagtgagga

SEQ ID NO: 604 - DNA, 23 bp, Artificial Sequence
  Synthetic oligonucleotide
agcagcatatcagggagtgagga

SEQ ID NO: 605 - DNA, 23 bp, Artificial Sequence
  Synthetic oligonucleotide
agcagcgagaaagagagtgagga

SEQ ID NO: 606 - DNA, 23 bp, Artificial Sequence
  Synthetic oligonucleotide
agcagcggtcttaggagtgagga

SEQ ID NO: 607 - DNA, 24 bp, Artificial Sequence
  Synthetic oligonucleotide
agcagggttcttcaagagtgagga

SEQ ID NO: 608 - DNA, 23 bp, Artificial Sequence
  Synthetic oligonucleotide
agctgagtcctaaagagtgagga

SEQ ID NO: 609 - DNA, 23 bp, Artificial Sequence
  Synthetic oligonucleotide
agctgagtcttaaggagtgagga

SEQ ID NO: 610 - DNA, 23 bp, Artificial Sequence
  Synthetic oligonucleotide
agctgggtcatgaggagtgagga

SEQ ID NO: 611 - DNA, 23 bp, Artificial Sequence
  Synthetic oligonucleotide
agctgggtcatgaggagtgagga

SEQ ID NO: 612 - DNA, 23 bp, Artificial Sequence
  Synthetic oligonucleotide
agctgtgtccacaggagtgagga

SEQ ID NO: 613 - DNA, 23 bp, Artificial Sequence
  Synthetic oligonucleotide
agctgtgtcttggagagtgagga

SEQ ID NO: 614 - DNA, 23 bp, Artificial Sequence
  Synthetic oligonucleotide
agtagcggcaaattgagtgagga

SEQ ID NO: 615 - DNA, 23 bp, Artificial Sequence
  Synthetic oligonucleotide
agtggcgtcccagtgagtgagga

SEQ ID NO: 616 - DNA, 23 bp, Artificial Sequence
  Synthetic oligonucleotide
ggcagagtcctagagagtgagga

SEQ ID NO: 617 - DNA, 24 bp, Artificial Sequence
  Synthetic oligonucleotide
tccagcgtcctcccagagtgagga

SEQ ID NO: 618 - DNA, 24 bp, Artificial Sequence
  Synthetic oligonucleotide
tgcagcggcgtaggggagtgagga

SEQ ID NO: 619 - DNA, 24 bp, Artificial Sequence
  Synthetic oligonucleotide
tgcagcgttaaaatagagtgagga

SEQ ID NO: 620 - DNA, 24 bp, Artificial Sequence
  Synthetic oligonucleotide
tgcagggtcgggcaggagtgagga

SEQ ID NO: 621 - DNA, 23 bp, Artificial Sequence
  Synthetic oligonucleotide
tgcagtgtccacaagagtgagga

SEQ ID NO: 622 - DNA, 24 bp, Artificial Sequence
  Synthetic oligonucleotide
agcaacgtccatagtgtgtgagaa

SEQ ID NO: 623 - DNA, 24 bp, Artificial Sequence
  Synthetic oligonucleotide
agcaacgtctaacccgagtgttga

SEQ ID NO: 624 - DNA, 23 bp, Artificial Sequence
  Synthetic oligonucleotide
agcaccgtccccctcagtgaggc

SEQ ID NO: 625 - DNA, 23 bp, Artificial Sequence
  Synthetic oligonucleotide
agcagcggcggctgcagtgaggc

SEQ ID NO: 626 - DNA, 24 bp, Artificial Sequence
  Synthetic oligonucleotide
agcagcggcttaagggggtgaggt

SEQ ID NO: 627 - DNA, 24 bp, Artificial Sequence
  Synthetic oligonucleotide
agcagtgtctaaaaggagtgagat

SEQ ID NO: 628 - DNA, 24 bp, Artificial Sequence
  Synthetic oligonucleotide
agaaacgtcgtggaggagtgaggg

SEQ ID NO: 629 - DNA, 24 bp, Artificial Sequence
  Synthetic oligonucleotide
agcaaagtctgtactgagtgaggg

SEQ ID NO: 630 - DNA, 23 bp, Artificial Sequence
  Synthetic oligonucleotide
agcaacatcatcttgagtgaggg

SEQ ID NO: 631 - DNA, 24 bp, Artificial Sequence
  Synthetic oligonucleotide
agcaacatctggttggagtgaggg

SEQ ID NO: 632 - DNA, 23 bp, Artificial Sequence
  Synthetic oligonucleotide
agcaacttcatcttgagtgaggg

SEQ ID NO: 633 - DNA, 23 bp, Artificial Sequence
  Synthetic oligonucleotide
agcaacttcctggcgagtgaggg

SEQ ID NO: 634 - DNA, 23 bp, Artificial Sequence
  Synthetic oligonucleotide
agcaatgtcaaaaagagtgaggc

SEQ ID NO: 635 - DNA, 23 bp, Artificial Sequence
  Synthetic oligonucleotide
agcaccgtggcttcgagtgaggc

SEQ ID NO: 636 - DNA, 23 bp, Artificial Sequence
  Synthetic oligonucleotide
agcacggtcatgatgagtgaggc

SEQ ID NO: 637 - DNA, 24 bp, Artificial Sequence
  Synthetic oligonucleotide
agcagcagcccacaggagtgaggg

SEQ ID NO: 638 - DNA, 23 bp, Artificial Sequence
  Synthetic oligonucleotide
agcagcagctaggggagtgaggg

SEQ ID NO: 639 - DNA, 23 bp, Artificial Sequence
  Synthetic oligonucleotide
agcagctcctctccgagtgaggt

SEQ ID NO: 640 - DNA, 23 bp, Artificial Sequence
  Synthetic oligonucleotide
agcagggtggcgtggagtgaggc

SEQ ID NO: 641 - DNA, 24 bp, Artificial Sequence
  Synthetic oligonucleotide
agcatagtctaggccgagtgaggc

SEQ ID NO: 642 - DNA, 23 bp, Artificial Sequence
  Synthetic oligonucleotide
agcatggtcccaaggagtgaggg

SEQ ID NO: 643 - DNA, 24 bp, Artificial Sequence
  Synthetic oligonucleotide
agcattgtctcatgtgagtgaggt

SEQ ID NO: 644 - DNA, 23 bp, Artificial Sequence
  Synthetic oligonucleotide
agcattgtctcctggagtgaggg

SEQ ID NO: 645 - DNA, 23 bp, Artificial Sequence
  Synthetic oligonucleotide
agtagcgtttttaggagtgaggt

SEQ ID NO: 646 - DNA, 23 bp, Artificial Sequence
  Synthetic oligonucleotide
atcagagtctctgggagtgaggc

SEQ ID NO: 647 - DNA, 24 bp, Artificial Sequence
  Synthetic oligonucleotide
atcagtgtccctcaggagtgaggc

SEQ ID NO: 648 - DNA, 24 bp, Artificial Sequence
  Synthetic oligonucleotide
ggcagagtcagggctgagtgaggc

SEQ ID NO: 649 - DNA, 24 bp, Artificial Sequence
  Synthetic oligonucleotide
ggcagcggccgctgtgagtgaggt

SEQ ID NO: 650 - DNA, 23 bp, Artificial Sequence
  Synthetic oligonucleotide
tgcagcttcatggtgagtgaggc

SEQ ID NO: 651 - DNA, 24 bp, Artificial Sequence
  Synthetic oligonucleotide
agcatagttacctgggagtgagga

SEQ ID NO: 652 - DNA, 24 bp, Artificial Sequence
  Synthetic oligonucleotide
agtaaagtctaagtagagtgagga

SEQ ID NO: 653 - DNA, 23 bp, Artificial Sequence
  Synthetic oligonucleotide
tgcagtctccttgggagtgaggt

SEQ ID NO: 654 - DNA, 23 bp, Artificial Sequence
  Synthetic oligonucleotide
  misc_feature (1)..(5): n is a, c, g, or t
nnnnncgatcgttgggaaccgga

SEQ ID NO: 655 - DNA, 42 bp, Artificial Sequence
  Synthetic oligonucleotide
  misc_feature (1)..(30): n is a, c, g, or t
nnnnnnnnnnnnnnnnnnnnnnnnnnnnnncagtggaacgaa

SEQ ID NO: 656 - DNA, 51 bp, Artificial Sequence
  Synthetic oligonucleotide
  misc_feature (1)..(31): n is a, c, g, or t
nnnnnnnnnnnnnnnnnnnnnnnnnnnnnnncagtggaacgaaaactcacg

SEQ ID NO: 657 - DNA, 52 bp, Artificial Sequence
  Synthetic oligonucleotide
  misc_feature (1)..(32): n is a, c, g, or t
nnnnnnnnnnnnnnnnnnnnnnnnnnnnnnnncagtggaacgaaaactcacg

SEQ ID NO: 658 - DNA, 53 bp, Artificial Sequence
  Synthetic oligonucleotide
  misc_feature (1)..(33): n is a, c, g, or t
nnnnnnnnnnnnnnnnnnnnnnnnnnnnnnnnncagtggaacgaaaactcacg

SEQ ID NO: 659 - DNA, 44 bp, Artificial Sequence
  Synthetic oligonucleotide
  misc_feature (1)..(24): n is a, c, g, or t
nnnnnnnnnnnnnnnnnnnnnnnncagtggaacgaaaactcacg

SEQ ID NO: 660 - DNA, 45 bp, Artificial Sequence
  Synthetic oligonucleotide
  misc_feature (1)..(25): n is a, c, g, or t
nnnnnnnnnnnnnnnnnnnnnnnnncagtggaacgaaaactcacg

SEQ ID NO: 661 - DNA, 46 bp, Artificial Sequence
  Synthetic oligonucleotide
  misc_feature (1)..(26): n is a, c, g, or t
nnnnnnnnnnnnnnnnnnnnnnnnnncagtggaacgaaaactcacg

SEQ ID NO: 662 - DNA, 47 bp, Artificial Sequence
  Synthetic oligonucleotide
  misc_feature (1)..(27): n is a, c, g, or t
nnnnnnnnnnnnnnnnnnnnnnnnnnncagtggaacgaaaactcacg

SEQ ID NO: 663 - DNA, 26 bp, Artificial Sequence
  Synthetic oligonucleotide
gcgacacggaaatgttgaatactcat

SEQ ID NO: 664 - DNA, 18 bp, Artificial Sequence
  Synthetic oligonucleotide
cagcgagtcagtgagcga

SEQ ID NO: 665 - DNA, 34 bp, Artificial Sequence
  Synthetic oligonucleotide
acactctttccctacacgacgctcttccgatctt

SEQ ID NO: 666 - DNA, 37 bp, Artificial Sequence
  Synthetic oligonucleotide
acactctttccctacacgacgctcttccgatctaatt

SEQ ID NO: 667 - DNA, 37 bp, Artificial Sequence
  Synthetic oligonucleotide
acactctttccctacacgacgctcttccgatctatat

SEQ ID NO: 668 - DNA, 37 bp, Artificial Sequence
  Synthetic oligonucleotide
acactctttccctacacgacgctcttccgatcttaat

SEQ ID NO: 669 - DNA, 37 bp, Artificial Sequence
  Synthetic oligonucleotide
acactctttccctacacgacgctcttccgatctcact

SEQ ID NO: 670 - DNA, 33 bp, Artificial Sequence
  Synthetic oligonucleotide
agatcggaagagcggttcagcaggaatgccgag

SEQ ID NO: 671 - DNA, 36 bp, Artificial Sequence
  Synthetic oligonucleotide
attagatcggaagagcggttcagcaggaatgccgag

SEQ ID NO: 672 - DNA, 36 bp, Artificial Sequence
  Synthetic oligonucleotide
tatagatcggaagagcggttcagcaggaatgccgag

SEQ ID NO: 673 - DNA, 36 bp, Artificial Sequence
  Synthetic oligonucleotide
ttaagatcggaagagcggttcagcaggaatgccgag

SEQ ID NO: 674 - DNA, 36 bp, Artificial Sequence
  Synthetic oligonucleotide
gtgagatcggaagagcggttcagcaggaatgccgag

SEQ ID NO: 675 - DNA, 60 bp, Artificial Sequence
  Synthetic oligonucleotide
caagcagaagacggcatacgagatcggtctcggcattcctgctgaaccgctcttccgatc

SEQ ID NO: 676 - DNA, 58 bp, Artificial Sequence
  Synthetic oligonucleotide
aatgatacggcgaccaccgagatctacactctttccctacacgacgctcttccgatct

SEQ ID NO: 677 - DNA, 20 bp, Artificial Sequence
  Synthetic oligonucleotide
atacatcggagccctgccaa

SEQ ID NO: 678 - DNA, 20 bp, Artificial Sequence
  Synthetic oligonucleotide
tcctgcctccgctctactcg

SEQ ID NO: 679 - DNA, 20 bp, Artificial Sequence
  Synthetic oligonucleotide
tcccacgttttccccttgac

SEQ ID NO: 680 - DNA, 23 bp, Artificial Sequence
  Synthetic oligonucleotide
gcactgccccagaaatattggtt

SEQ ID NO: 681 - DNA, 20 bp, Artificial Sequence
  Synthetic oligonucleotide
atgccacccctgccagataa

SEQ ID NO: 682 - DNA, 20 bp, Artificial Sequence
  Synthetic oligonucleotide
tctgcttctgcccttctgga

SEQ ID NO: 683 - DNA, 25 bp, Artificial Sequence
  Synthetic oligonucleotide
ccccagtgcttaacatagttcttgg

SEQ ID NO: 684 - DNA, 23 bp, Artificial Sequence
  Synthetic oligonucleotide
ggcaccagaacttactcactgcc

SEQ ID NO: 685 - DNA, 20 bp, Artificial Sequence
  Synthetic oligonucleotide
gttttgggggtcatggcaaa

SEQ ID NO: 686 - DNA, 21 bp, Artificial Sequence
  Synthetic oligonucleotide
tttccctggtgatgcactcct

SEQ ID NO: 687 - DNA, 20 bp, Artificial Sequence
  Synthetic oligonucleotide
ttgggggaatgagattggga

SEQ ID NO: 688 - DNA, 20 bp, Artificial Sequence
  Synthetic oligonucleotide
ccttcccatggtcacagagg

SEQ ID NO: 689 - DNA, 20 bp, Artificial Sequence
  Synthetic oligonucleotide
tcctcccgttgaggaagcac

SEQ ID NO: 690 - DNA, 20 bp, Artificial Sequence
  Synthetic oligonucleotide
cagaccgctgctgctgagac

SEQ ID NO: 691 - DNA, 20 bp, Artificial Sequence
  Synthetic oligonucleotide
tgggttcctcgggttctctg

SEQ ID NO: 692 - DNA, 20 bp, Artificial Sequence
  Synthetic oligonucleotide
aggcataagccactgcaccc

SEQ ID NO: 693 - DNA, 26 bp, Artificial Sequence
  Synthetic oligonucleotide
gaggatattttattgctggctcttgc

SEQ ID NO: 694 - DNA, 20 bp, Artificial Sequence
  Synthetic oligonucleotide
gctgaggcccacctttcctt

SEQ ID NO: 695 - DNA, 20 bp, Artificial Sequence
  Synthetic oligonucleotide
tgttttgggtgcatgtgggt

SEQ ID NO: 696 - DNA, 20 bp, Artificial Sequence
  Synthetic oligonucleotide
ctgggtcagctgggccatac

SEQ ID NO: 697 - DNA, 21 bp, Artificial Sequence
  Synthetic oligonucleotide
ccagccttggaaaaatggaca

SEQ ID NO: 698 - DNA, 25 bp, Artificial Sequence
  Synthetic oligonucleotide
catggatgtaatgggttgtatctgc

SEQ ID NO: 699 - DNA, 20 bp, Artificial Sequence
  Synthetic oligonucleotide
aggatgcattgtcccccaga

SEQ ID NO: 700 - DNA, 20 bp, Artificial Sequence
  Synthetic oligonucleotide
cgttggcttgcagaagggac

SEQ ID NO: 701 - DNA, 23 bp, Artificial Sequence
  Synthetic oligonucleotide
tgacccaactaagtctgtgaccc

SEQ ID NO: 702 - DNA, 24 bp, Artificial Sequence
  Synthetic oligonucleotide
tgggttgtgtttttgactgacaga

SEQ ID NO: 703 - DNA, 20 bp, Artificial Sequence
  Synthetic oligonucleotide
cacccccatgcaggaaaatg

SEQ ID NO: 704 - DNA, 20 bp, Artificial Sequence
  Synthetic oligonucleotide
ggccattggttctggaggaa

SEQ ID NO: 705 - DNA, 20 bp, Artificial Sequence
  Synthetic oligonucleotide
agtcagcaatgccccagagc

SEQ ID NO: 706 - DNA, 22 bp, Artificial Sequence
  Synthetic oligonucleotide
cctgggagggtgactagttgga

SEQ ID NO: 707 - DNA, 20 bp, Artificial Sequence
  Synthetic oligonucleotide
tggcaattaggatgtgccag

SEQ ID NO: 708 - DNA, 20 bp, Artificial Sequence
  Synthetic oligonucleotide
tgccccacatcttcaccaga

SEQ ID NO: 709 - DNA, 20 bp, Artificial Sequence
  Synthetic oligonucleotide
gttgcatctgcggtcttcca

SEQ ID NO: 710 - DNA, 20 bp, Artificial Sequence
  Synthetic oligonucleotide
tagtggccccaacatgcaaa

SEQ ID NO: 711 - DNA, 20 bp, Artificial Sequence
  Synthetic oligonucleotide
cctttccaaagcccattccc

SEQ ID NO: 712 - DNA, 20 bp, Artificial Sequence
  Synthetic oligonucleotide
ttcactgccttcaggcctcc

SEQ ID NO: 713 - DNA, 20 bp, Artificial Sequence
  Synthetic oligonucleotide
cacagggacccaggactgct

SEQ ID NO: 714 - DNA, 20 bp, Artificial Sequence
  Synthetic oligonucleotide
gcaccaggcttctctgccat

SEQ ID NO: 715 - DNA, 20 bp, Artificial Sequence
  Synthetic oligonucleotide
ccaaggcgaggacattgagg

SEQ ID NO: 716 - DNA, 20 bp, Artificial Sequence
  Synthetic oligonucleotide
accatagtccagcggggtca

SEQ ID NO: 717 - DNA, 20 bp, Artificial Sequence
  Synthetic oligonucleotide
agaaagggtggtcggggaag

SEQ ID NO: 718 - DNA, 20 bp, Artificial Sequence
  Synthetic oligonucleotide
ttcccatggggtctcagctc

SEQ ID NO: 719 - DNA, 20 bp, Artificial Sequence
  Synthetic oligonucleotide
cagcaaggatgcccttcacc

SEQ ID NO: 720 - DNA, 20 bp, Artificial Sequence
  Synthetic oligonucleotide
ggcttgagctggaaggacca

SEQ ID NO: 721 - DNA, 20 bp, Artificial Sequence
  Synthetic oligonucleotide
aaccgagtttgcaccgtcgt

SEQ ID NO: 722 - DNA, 20 bp, Artificial Sequence
  Synthetic oligonucleotide
tatcctcccctttcccctga

SEQ ID NO: 723 - DNA, 20 bp, Artificial Sequence
  Synthetic oligonucleotide
agaacccggaatccctttgc

SEQ ID NO: 724 - DNA, 20 bp, Artificial Sequence
  Synthetic oligonucleotide
ggtctctgccatgcccaact

SEQ ID NO: 725 - DNA, 20 bp, Artificial Sequence
  Synthetic oligonucleotide
ccccttgggatccttgtcct

SEQ ID NO: 726 - DNA, 20 bp, Artificial Sequence
  Synthetic oligonucleotide
ctaggcctgtgggctgagga

SEQ ID NO: 727 - DNA, 20 bp, Artificial Sequence
  Synthetic oligonucleotide
tacctgaaacccctggccct

SEQ ID NO: 728 - DNA, 20 bp, Artificial Sequence
  Synthetic oligonucleotide
cgggggcctgacattagtga

SEQ ID NO: 729 - DNA, 21 bp, Artificial Sequence
  Synthetic oligonucleotide
tgcattggctcaagaattggg

SEQ ID NO: 730 - DNA, 21 bp, Artificial Sequence
  Synthetic oligonucleotide
gcgctccctgtgttcagtacc

SEQ ID NO: 731 - DNA, 20 bp, Artificial Sequence
  Synthetic oligonucleotide
tgtttgggttatgggggcag

SEQ ID NO: 732 - DNA, 21 bp, Artificial Sequence
  Synthetic oligonucleotide
aaggagacttctcaggcccca

SEQ ID NO: 733 - DNA, 20 bp, Artificial Sequence
  Synthetic oligonucleotide
cttgggggcagacagcatct

SEQ ID NO: 734 - DNA, 20 bp, Artificial Sequence
  Synthetic oligonucleotide
tggcctcaagcaatcctcct

SEQ ID NO: 735 - DNA, 20 bp, Artificial Sequence
  Synthetic oligonucleotide
ccaaagagcctggaggagca

SEQ ID NO: 736 - DNA, 23 bp, Artificial Sequence
  Synthetic oligonucleotide
ccagcctgtgaagctggaagtaa

SEQ ID NO: 737 - DNA, 20 bp, Artificial Sequence
  Synthetic oligonucleotide
catctgaatgcccatgctgc

SEQ ID NO: 738 - DNA, 21 bp, Artificial Sequence
  Synthetic oligonucleotide
cctcaaagaaacggctgctga

SEQ ID NO: 739 - DNA, 20 bp, Artificial Sequence
  Synthetic oligonucleotide
cgggctctcctcctcaaaga

SEQ ID NO: 740 - DNA, 20 bp, Artificial Sequence
  Synthetic oligonucleotide
ggaatcgcatgacctgaggc

SEQ ID NO: 741 - DNA, 20 bp, Artificial Sequence
  Synthetic oligonucleotide
cccgccagacacattcctct

SEQ ID NO: 742 - DNA, 22 bp, Artificial Sequence
  Synthetic oligonucleotide
ccgcacctttttcctatgtggt

SEQ ID NO: 743 - DNA, 20 bp, Artificial Sequence
  Synthetic oligonucleotide
ggtacatgggccgcactttc

SEQ ID NO: 744 - DNA, 20 bp, Artificial Sequence
  Synthetic oligonucleotide
ttacacctgctggcaggcaa

SEQ ID NO: 745 - DNA, 20 bp, Artificial Sequence
  Synthetic oligonucleotide
tggccaagcctgcctaactc

SEQ ID NO: 746 - DNA, 20 bp, Artificial Sequence
  Synthetic oligonucleotide
ccccttctgctcctgcttca

SEQ ID NO: 747 - DNA, 20 bp, Artificial Sequence
  Synthetic oligonucleotide
tgattttcagcgtggagggc

SEQ ID NO: 748 - DNA, 20 bp, Artificial Sequence
  Synthetic oligonucleotide
aagctggcagccactcttca

SEQ ID NO: 749 - DNA, 23 bp, Artificial Sequence
  Synthetic oligonucleotide
tcgattctccatacaccatcaat

SEQ ID NO: 750 - DNA, 20 bp, Artificial Sequence
  Synthetic oligonucleotide
aggtcctggcattgtctggg

SEQ ID NO: 751 - DNA, 20 bp, Artificial Sequence
  Synthetic oligonucleotide
ctgggaggcagccagtcaag

SEQ ID NO: 752 - DNA, 21 bp, Artificial Sequence
  Synthetic oligonucleotide
caggtgtgcattttgttgcca

SEQ ID NO: 753 - DNA, 20 bp, Artificial Sequence
  Synthetic oligonucleotide
tggccctggtcatgtgaaaa

SEQ ID NO: 754 - DNA, 20 bp, Artificial Sequence
  Synthetic oligonucleotide
ttgataagggcggtgccact

SEQ ID NO: 755 - DNA, 20 bp, Artificial Sequence
  Synthetic oligonucleotide
catccccttgaccaacaggc

SEQ ID NO: 756 - DNA, 20 bp, Artificial Sequence
  Synthetic oligonucleotide
actgccaatggaccctctcg

SEQ ID NO: 757 - DNA, 20 bp, Artificial Sequence
  Synthetic oligonucleotide
ggggagctagaatggtgggc

SEQ ID NO: 758 - DNA, 20 bp, Artificial Sequence
  Synthetic oligonucleotide
cccatgctggtcctgctgtt

SEQ ID NO: 759 - DNA, 20 bp, Artificial Sequence
  Synthetic oligonucleotide
ggggtcaccagggaaggttt

SEQ ID NO: 760 - DNA, 20 bp, Artificial Sequence
  Synthetic oligonucleotide
tgcccagagaccttccaagc

SEQ ID NO: 761 - DNA, 20 bp, Artificial Sequence
  Synthetic oligonucleotide
gccaatgtgcaatcgagacg

SEQ ID NO: 762 - DNA, 20 bp, Artificial Sequence
  Synthetic oligonucleotide
tgacttgaactgggtccccc

SEQ ID NO: 763 - DNA, 20 bp, Artificial Sequence
  Synthetic oligonucleotide
cccaatccagacaccacacg

SEQ ID NO: 764 - DNA, 20 bp, Artificial Sequence
  Synthetic oligonucleotide
ggtgaggaaggatgggggtt

SEQ ID NO: 765 - DNA, 20 bp, Artificial Sequence
  Synthetic oligonucleotide
tgcccatgttgttgctccac

SEQ ID NO: 766 - DNA, 20 bp, Artificial Sequence
  Synthetic oligonucleotide
tcacagctcccctttctcgg

SEQ ID NO: 767 - DNA, 20 bp, Artificial Sequence
  Synthetic oligonucleotide
cctaggcacagtgggggatg

SEQ ID NO: 768 - DNA, 21 bp, Artificial Sequence
  Synthetic oligonucleotide
ccatgagcacaattgccaaaa

SEQ ID NO: 769 - DNA, 20 bp, Artificial Sequence
  Synthetic oligonucleotide
ctgccaagaacaggagggga

SEQ ID NO: 770 - DNA, 20 bp, Artificial Sequence
  Synthetic oligonucleotide
atcggggcagggctagagtc

SEQ ID NO: 771 - DNA, 20 bp, Artificial Sequence
  Synthetic oligonucleotide
gccgttagtgcatttgcctg

SEQ ID NO: 772 - DNA, 20 bp, Artificial Sequence
  Synthetic oligonucleotide
gttcctcccagagtggggct

SEQ ID NO: 773 - DNA, 19 bp, Artificial Sequence
  Synthetic oligonucleotide
aggcctggcggtaaccttg

SEQ ID NO: 774 - DNA, 22 bp, Artificial Sequence
  Synthetic oligonucleotide
gggatcctacaggatgggacaa

SEQ ID NO: 775 - DNA, 21 bp, Artificial Sequence
  Synthetic oligonucleotide
gccaccaaatgtccactggtt

SEQ ID NO: 776 - DNA, 20 bp, Artificial Sequence
  Synthetic oligonucleotide
gcaccagcctcttcgatggt

SEQ ID NO: 777 - DNA, 21 bp, Artificial Sequence
  Synthetic oligonucleotide
aatggggcaaaaggcaagaaa

SEQ ID NO: 778 - DNA, 22 bp, Artificial Sequence
  Synthetic oligonucleotide
tggcgagataggctctgctaca

SEQ ID NO: 779 - DNA, 20 bp, Artificial Sequence
  Synthetic oligonucleotide
tgtgggcatgagaccacagg

SEQ ID NO: 780 - DNA, 25 bp, Artificial Sequence
  Synthetic oligonucleotide
tcctattttcagatgcactcgaacc

SEQ ID NO: 781 - DNA, 23 bp, Artificial Sequence
  Synthetic oligonucleotide
ggaccttcttgccctcatgattc

SEQ ID NO: 782 - DNA, 21 bp, Artificial Sequence
  Synthetic oligonucleotide
ccttgcaaaggcttgcctaaa

SEQ ID NO: 783 - DNA, 20 bp, Artificial Sequence
  Synthetic oligonucleotide
tggcttgcagaggaggtgag

SEQ ID NO: 784 - DNA, 20 bp, Artificial Sequence
  Synthetic oligonucleotide
gcttcagcacatcagtggcg

SEQ ID NO: 785 - DNA, 21 bp, Artificial Sequence
  Synthetic oligonucleotide
ggtgaggccactgtaagccaa

SEQ ID NO: 786 - DNA, 20 bp, Artificial Sequence
  Synthetic oligonucleotide
gagttgagctgtcagcgggg

SEQ ID NO: 787 - DNA, 22 bp, Artificial Sequence
  Synthetic oligonucleotide
tgttttctgcagttttgcaggg

SEQ ID NO: 788 - DNA, 20 bp, Artificial Sequence
  Synthetic oligonucleotide
gctctggcaccaggcacact

SEQ ID NO: 789 - DNA, 20 bp, Artificial Sequence
  Synthetic oligonucleotide
gccaaaccctttccagggag

SEQ ID NO: 790 - DNA, 20 bp, Artificial Sequence
  Synthetic oligonucleotide
cctcagccagttggaatcgg

SEQ ID NO: 791 - DNA, 20 bp, Artificial Sequence
  Synthetic oligonucleotide
tgggtggtgaaaatggggtt

SEQ ID NO: 792 - DNA, 25 bp, Artificial Sequence
  Synthetic oligonucleotide
ggaatgtgtggaactcaatttcttt

SEQ ID NO: 793 - DNA, 20 bp, Artificial Sequence
  Synthetic oligonucleotide
ccacaagggtcatctgggga

SEQ ID NO: 794 - DNA, 20 bp, Artificial Sequence
  Synthetic oligonucleotide
cctggagtggtttggcttcg

SEQ ID NO: 795 - DNA, 20 bp, Artificial Sequence
  Synthetic oligonucleotide
ggctcctggggtcattttcc

SEQ ID NO: 796 - DNA, 20 bp, Artificial Sequence
  Synthetic oligonucleotide
gtgtgtttccgcacaccctg

SEQ ID NO: 797 - DNA, 20 bp, Artificial Sequence
  Synthetic oligonucleotide
ccatcgccgtgtctgagtgt

SEQ ID NO: 798 - DNA, 20 bp, Artificial Sequence
  Synthetic oligonucleotide
aggcaatggcaccaaaatgg

SEQ ID NO: 799 - DNA, 23 bp, Artificial Sequence
  Synthetic oligonucleotide
ttttgactttgagaaccccctga

SEQ ID NO: 800 - DNA, 21 bp, Artificial Sequence
  Synthetic oligonucleotide
gctgagtgcaaagctcaggga

SEQ ID NO: 801 - DNA, 22 bp, Artificial Sequence
  Synthetic oligonucleotide
ggaaaaacaggtcagagatggc

SEQ ID NO: 802 - DNA, 20 bp, Artificial Sequence
  Synthetic oligonucleotide
accccaaaggtgaccgtcct

SEQ ID NO: 803 - DNA, 20 bp, Artificial Sequence
  Synthetic oligonucleotide
gtccctcacgacgaccgact

SEQ ID NO: 804 - DNA, 20 bp, Artificial Sequence
  Synthetic oligonucleotide
tggtttgttgggggatcagg

SEQ ID NO: 805 - DNA, 21 bp, Artificial Sequence
  Synthetic oligonucleotide
gcctacctcaatgcaggcaaa

SEQ ID NO: 806 - DNA, 20 bp, Artificial Sequence
  Synthetic oligonucleotide
ggaggatcgccaagacctga

SEQ ID NO: 807 - DNA, 20 bp, Artificial Sequence
  Synthetic oligonucleotide
actcccagacaaaccccgct

SEQ ID NO: 808 - DNA, 20 bp, Artificial Sequence
  Synthetic oligonucleotide
tgtgaaggcccaaaaccctg

SEQ ID NO: 809 - DNA, 20 bp, Artificial Sequence
  Synthetic oligonucleotide
tgggcagccctaggtccttt

SEQ ID NO: 810 - DNA, 22 bp, Artificial Sequence
  Synthetic oligonucleotide
tgatgagtaacttgggcgaaaa

SEQ ID NO: 811 - DNA, 21 bp, Artificial Sequence
  Synthetic oligonucleotide
ggaaaatccagcaaggtgaaa

SEQ ID NO: 812 - DNA, 24 bp, Artificial Sequence
  Synthetic oligonucleotide
caactctctaacagcaaagtggca

SEQ ID NO: 813 - DNA, 21 bp, Artificial Sequence
  Synthetic oligonucleotide
gcctcaaaagcataaacagca

SEQ ID NO: 814 - DNA, 20 bp, Artificial Sequence
  Synthetic oligonucleotide
agggcggactcattgctttg

SEQ ID NO: 815 - DNA, 26 bp, Artificial Sequence
  Synthetic oligonucleotide
gaaaccagaagttcacaacaatgctt

SEQ ID NO: 816 - DNA, 21 bp, Artificial Sequence
  Synthetic oligonucleotide
tggcaatgcctaatcagacca

SEQ ID NO: 817 - DNA, 21 bp, Artificial Sequence
  Synthetic oligonucleotide
gagtttggggaaaagccactt

SEQ ID NO: 818 - DNA, 20 bp, Artificial Sequence
  Synthetic oligonucleotide
tgctctgccaactgtgaggg

SEQ ID NO: 819 - DNA, 22 bp, Artificial Sequence
  Synthetic oligonucleotide
tccagggagtgaggtgaagaca

SEQ ID NO: 820 - DNA, 20 bp, Artificial Sequence
  Synthetic oligonucleotide
tcacatctccgcctcacgat

SEQ ID NO: 821 - DNA, 20 bp, Artificial Sequence
  Synthetic oligonucleotide
ctgacacagtggccagcagc

SEQ ID NO: 822 - DNA, 20 bp, Artificial Sequence
  Synthetic oligonucleotide
gagggcagaagggggtgagt

SEQ ID NO: 823 - DNA, 22 bp, Artificial Sequence
  Synthetic oligonucleotide
tggagtgacatgtatgaagcca

SEQ ID NO: 824 - DNA, 21 bp, Artificial Sequence
  Synthetic oligonucleotide
tgaaccccggatttttcaacc

SEQ ID NO: 825 - DNA, 21 bp, Artificial Sequence
  Synthetic oligonucleotide
ttgggaaagctttgatgctgg

SEQ ID NO: 826 - DNA, 20 bp, Artificial Sequence
  Synthetic oligonucleotide
ccctaggggtcactggagca

SEQ ID NO: 827 - DNA, 20 bp, Artificial Sequence
  Synthetic oligonucleotide
ttggctgctggcatttggta

SEQ ID NO: 828 - DNA, 21 bp, Artificial Sequence
  Synthetic oligonucleotide
tccgttgcttcatccttccaa

SEQ ID NO: 829 - DNA, 23 bp, Artificial Sequence
  Synthetic oligonucleotide
tggagagggtttactttcccaga

SEQ ID NO: 830 - DNA, 20 bp, Artificial Sequence
  Synthetic oligonucleotide
gctcagggcctggcttacag

SEQ ID NO: 831 - DNA, 25 bp, Artificial Sequence
  Synthetic oligonucleotide
tccactcacaaatttacctttccac

SEQ ID NO: 832 - DNA, 20 bp, Artificial Sequence
  Synthetic oligonucleotide
ccgcataaaggaggtgtcgg

SEQ ID NO: 833 - DNA, 21 bp, Artificial Sequence
  Synthetic oligonucleotide
ggagagtcttccgcctgtgtt

SEQ ID NO: 834 - DNA, 26 bp, Artificial Sequence
  Synthetic oligonucleotide
gcacatatcatgcactgtgactgtaa

SEQ ID NO: 835 - DNA, 19 bp, Artificial Sequence
  Synthetic oligonucleotide
caaccccacacgcacacac

SEQ ID NO: 836 - DNA, 21 bp, Artificial Sequence
  Synthetic oligonucleotide
aatggccagaaaattcccaaa

SEQ ID NO: 837 - DNA, 20 bp, Artificial Sequence
  Synthetic oligonucleotide
tgactggaaccgtgcagcat

SEQ ID NO: 838 - DNA, 20 bp, Artificial Sequence
  Synthetic oligonucleotide
tcgggggtccatggtatttg

SEQ ID NO: 839 - DNA, 20 bp, Artificial Sequence
  Synthetic oligonucleotide
ccccaagtcagaccctgcat

SEQ ID NO: 840 - DNA, 20 bp, Artificial Sequence
  Synthetic oligonucleotide
ttctccccaaggaaggctga

SEQ ID NO: 841 - DNA, 20 bp, Artificial Sequence
  Synthetic oligonucleotide
gccaccatgcccagtctaca

SEQ ID NO: 842 - DNA, 20 bp, Artificial Sequence
  Synthetic oligonucleotide
atggccttccccaactgtga

SEQ ID NO: 843 - DNA, 22 bp, Artificial Sequence
  Synthetic oligonucleotide
cgttgtgattgaggagacgagg

SEQ ID NO: 844 - DNA, 22 bp, Artificial Sequence
  Synthetic oligonucleotide
tggagcaactgaacatcttggg

SEQ ID NO: 845 - DNA, 21 bp, Artificial Sequence
  Synthetic oligonucleotide
cataaccaccaggacatccgc

SEQ ID NO: 846 - DNA, 23 bp, Artificial Sequence
  Synthetic oligonucleotide
tgttgccagaagtatcaggtccc

SEQ ID NO: 847 - DNA, 20 bp, Artificial Sequence
  Synthetic oligonucleotide
gcagagaaggcagcagcaca

SEQ ID NO: 848 - DNA, 21 bp, Artificial Sequence
  Synthetic oligonucleotide
tggaggaagcaggaaaggcat

SEQ ID NO: 849 - DNA, 20 bp, Artificial Sequence
  Synthetic oligonucleotide
tcaacaggcagctacagggc

SEQ ID NO: 850 - DNA, 20 bp, Artificial Sequence
  Synthetic oligonucleotide
caaatgttggggtgtgggtg

SEQ ID NO: 851 - DNA, 22 bp, Artificial Sequence
  Synthetic oligonucleotide
caagctggatgtggatgcagag

SEQ ID NO: 852 - DNA, 20 bp, Artificial Sequence
  Synthetic oligonucleotide
gcctgaagatgcatttgccc

SEQ ID NO: 853 - DNA, 24 bp, Artificial Sequence
  Synthetic oligonucleotide
tcacacagtggtaatggacaggaa

SEQ ID NO: 854 - DNA, 20 bp, Artificial Sequence
  Synthetic oligonucleotide
gcgcaagttcccctttctga

SEQ ID NO: 855 - DNA, 20 bp, Artificial Sequence
  Synthetic oligonucleotide
tccagcatctgctcctggtg

SEQ ID NO: 856 - DNA, 20 bp, Artificial Sequence
  Synthetic oligonucleotide
tgaagggaagccacagctcc

SEQ ID NO: 857 - DNA, 20 bp, Artificial Sequence
  Synthetic oligonucleotide
gccatgggatggcagttagg

SEQ ID NO: 858 - DNA, 20 bp, Artificial Sequence
  Synthetic oligonucleotide
ttccatggcagtgaagggtg

SEQ ID NO: 859 - DNA, 20 bp, Artificial Sequence
  Synthetic oligonucleotide
cagagggtgtggtggtgtcg

SEQ ID NO: 860 - DNA, 20 bp, Artificial Sequence
  Synthetic oligonucleotide
ccagtgggctgagtggatga

SEQ ID NO: 861 - DNA, 18 bp, Artificial Sequence
  Synthetic oligonucleotide
ccgccacacccattcctc

SEQ ID NO: 862 - DNA, 20 bp, Artificial Sequence
  Synthetic oligonucleotide
gccgctcgaaaagagggaat

SEQ ID NO: 863 - DNA, 20 bp, Artificial Sequence
  Synthetic oligonucleotide
ggccccttgaaaagagggaa

SEQ ID NO: 864 - DNA, 20 bp, Artificial Sequence
  Synthetic oligonucleotide
cgggctctcctcctcaaaga

SEQ ID NO: 865 - DNA, 20 bp, Artificial Sequence
  Synthetic oligonucleotide
catctgaatgcccatgctgc

SEQ ID NO: 866 - DNA, 25 bp, Artificial Sequence
  Synthetic oligonucleotide
tcagatgtgctaggacacagatgac

SEQ ID NO: 867 - DNA, 20 bp, Artificial Sequence
  Synthetic oligonucleotide
ggacagctgggaattggtgg

SEQ ID NO: 868 - DNA, 20 bp, Artificial Sequence
  Synthetic oligonucleotide
gctggtgtgagcaagaggca

SEQ ID NO: 869 - DNA, 20 bp, Artificial Sequence
  Synthetic oligonucleotide
tgatcagttagccctggggg

SEQ ID NO: 870 - DNA, 21 bp, Artificial Sequence
  Synthetic oligonucleotide
ccttccttgcagctcaaaccc

SEQ ID NO: 871 - DNA, 20 bp, Artificial Sequence
  Synthetic oligonucleotide
acggcaaagccagagcaaag

SEQ ID NO: 872 - DNA, 20 bp, Artificial Sequence
  Synthetic oligonucleotide
tctcagggcttctgtgtgcg

SEQ ID NO: 873 - DNA, 20 bp, Artificial Sequence
  Synthetic oligonucleotide
gcaaccaactcccaacaggg

SEQ ID NO: 874 - DNA, 20 bp, Artificial Sequence
  Synthetic oligonucleotide
tggttgcctgtttcacaccc

SEQ ID NO: 875 - DNA, 21 bp, Artificial Sequence
  Synthetic oligonucleotide
gccctgtaagctgaagctgga

SEQ ID NO: 876 - DNA, 22 bp, Artificial Sequence
  Synthetic oligonucleotide
gcctgccaggtatttcctgtgt

SEQ ID NO: 877 - DNA, 20 bp, Artificial Sequence
  Synthetic oligonucleotide
aactgcaagtggcctcccag

SEQ ID NO: 878 - DNA, 20 bp, Artificial Sequence
  Synthetic oligonucleotide
tagagggaggtgcttgccca

SEQ ID NO: 879 - DNA, 20 bp, Artificial Sequence
  Synthetic oligonucleotide
gcttgggcactgatcctgct

SEQ ID NO: 880 - DNA, 20 bp, Artificial Sequence
  Synthetic oligonucleotide
gagttgcccaggtcagccat

SEQ ID NO: 881 - DNA, 21 bp, Artificial Sequence
  Synthetic oligonucleotide
caaggtacacagctgcccagg

SEQ ID NO: 882 - DNA, 20 bp, Artificial Sequence
  Synthetic oligonucleotide
ggaggctcagcggagaggat

SEQ ID NO: 883 - DNA, 20 bp, Artificial Sequence
  Synthetic oligonucleotide
agttgcggggaggtgctaca

SEQ ID NO: 884 - DNA, 20 bp, Artificial Sequence
  Synthetic oligonucleotide
tggccaaggcctctctaagc

SEQ ID NO: 885 - DNA, 21 bp, Artificial Sequence
  Synthetic oligonucleotide
tgcatgcctctgactgatgct

SEQ ID NO: 886 - DNA, 20 bp, Artificial Sequence
  Synthetic oligonucleotide
ctggggctacagccctcctt

SEQ ID NO: 887 - DNA, 21 bp, Artificial Sequence
  Synthetic oligonucleotide
tgcagattttaggggttgcca

SEQ ID NO: 888 - DNA, 20 bp, Artificial Sequence
  Synthetic oligonucleotide
gtaggctctgccacgccagt

SEQ ID NO: 889 - DNA, 26 bp, Artificial Sequence
  Synthetic oligonucleotide
gacaagttagaccatcctagccctca

SEQ ID NO: 890 - DNA, 20 bp, Artificial Sequence
  Synthetic oligonucleotide
tgtgcctccactgacgcatt

SEQ ID NO: 891 - DNA, 20 bp, Artificial Sequence
  Synthetic oligonucleotide
gggctgacacactgagggct

SEQ ID NO: 892 - DNA, 27 bp, Artificial Sequence
  Synthetic oligonucleotide
tgagttatttcgaaagaggaaacagtg

SEQ ID NO: 893 - DNA, 20 bp, Artificial Sequence
  Synthetic oligonucleotide
agcccatctaccatccagcg

SEQ ID NO: 894 - DNA, 20 bp, Artificial Sequence
  Synthetic oligonucleotide
cccctggcattccctacaca

SEQ ID NO: 895 - DNA, 22 bp, Artificial Sequence
  Synthetic oligonucleotide
tccctttcaacccctgtagtgc

SEQ ID NO: 896 - DNA, 20 bp, Artificial Sequence
  Synthetic oligonucleotide
actgagggaggcagcactgg

SEQ ID NO: 897 - DNA, 20 bp, Artificial Sequence
  Synthetic oligonucleotide
aagctccagccctgtacccc

SEQ ID NO: 898 - DNA, 20 bp, Artificial Sequence
  Synthetic oligonucleotide
cagcccaggacaagggtagc

SEQ ID NO: 899 - DNA, 20 bp, Artificial Sequence
  Synthetic oligonucleotide
ttccccaagcagtccagctc

SEQ ID NO: 900 - DNA, 20 bp, Artificial Sequence
  Synthetic oligonucleotide
cctttggcagactgtggcct

SEQ ID NO: 901 - DNA, 20 bp, Artificial Sequence
  Synthetic oligonucleotide
cagacctcgtggtgcatgtg

SEQ ID NO: 902 - DNA, 24 bp, Artificial Sequence
  Synthetic oligonucleotide
tggacagggaattactcagaccag

SEQ ID NO: 903 - DNA, 20 bp, Artificial Sequence
  Synthetic oligonucleotide
tttgactcccccgcattgtt

SEQ ID NO: 904 - DNA, 20 bp, Artificial Sequence
  Synthetic oligonucleotide
gtgctcactgaagcccacca

SEQ ID NO: 905 - DNA, 20 bp, Artificial Sequence
  Synthetic oligonucleotide
gggaactgtgcctttgcgtc

SEQ ID NO: 906 - DNA, 20 bp, Artificial Sequence
  Synthetic oligonucleotide
ggcaggcacctgtagtccca

SEQ ID NO: 907 - DNA, 20 bp, Artificial Sequence
  Synthetic oligonucleotide
cagggaagggtgttggcttg

SEQ ID NO: 908 - DNA, 20 bp, Artificial Sequence
  Synthetic oligonucleotide
ttcgcccagctcatcaacaa

SEQ ID NO: 909 - DNA, 20 bp, Artificial Sequence
  Synthetic oligonucleotide
tgggctgccatgacaaacag

SEQ ID NO: 910 - DNA, 21 bp, Artificial Sequence
  Synthetic oligonucleotide
gaagccaactgccttgtgagc

SEQ ID NO: 911 - DNA, 20 bp, Artificial Sequence
  Synthetic oligonucleotide
ggctcagggagtttgagcca

SEQ ID NO: 912 - DNA, 23 bp, Artificial Sequence
  Synthetic oligonucleotide
gggagagaaccatgaatttccca

SEQ ID NO: 913 - DNA, 20 bp, Artificial Sequence
  Synthetic oligonucleotide
cccaccctatgcacagagcc

SEQ ID NO: 914 - DNA, 25 bp, Artificial Sequence
  Synthetic oligonucleotide
caacggtttagtttagttccggttt

SEQ ID NO: 915 - DNA, 20 bp, Artificial Sequence
  Synthetic oligonucleotide
ggtggggtatgcactggtca

SEQ ID NO: 916 - DNA, 20 bp, Artificial Sequence
  Synthetic oligonucleotide
ttgcttgcagggtgtggaaa

SEQ ID NO: 917 - DNA, 20 bp, Artificial Sequence
  Synthetic oligonucleotide
cggaggcatcatccactgag

SEQ ID NO: 918 - DNA, 20 bp, Artificial Sequence
  Synthetic oligonucleotide
tggagccctggagttcttgg

SEQ ID NO: 919 - DNA, 20 bp, Artificial Sequence
  Synthetic oligonucleotide
tgtgctccatcctcctccct

SEQ ID NO: 920 - DNA, 20 bp, Artificial Sequence
  Synthetic oligonucleotide
gctcttggcttcccaaccct

SEQ ID NO: 921 - DNA, 20 bp, Artificial Sequence
  Synthetic oligonucleotide
cagcaggaacatcatccccc

SEQ ID NO: 922 - DNA, 22 bp, Artificial Sequence
  Synthetic oligonucleotide
gcagccttcaccatacctgtga

SEQ ID NO: 923 - DNA, 25 bp, Artificial Sequence
  Synthetic oligonucleotide
ccttgtcctttctcagttagacaca

SEQ ID NO: 924 - DNA, 20 bp, Artificial Sequence
  Synthetic oligonucleotide
ggcaacacagcaagacccct

SEQ ID NO: 925 - DNA, 9 bp, Artificial Sequence
  Synthetic oligonucleotide
agcagcttc

SEQ ID NO: 926 - DNA, 9 bp, Artificial Sequence
  Synthetic oligonucleotide
agcatcgtc

SEQ ID NO: 927 - DNA, 9 bp, Artificial Sequence
  Synthetic oligonucleotide
agcaacgtc

SEQ ID NO: 928 - DNA, 9 bp, Artificial Sequence
  Synthetic oligonucleotide
agctgggtc

SEQ ID NO: 929 - DNA, 9 bp, Artificial Sequence
  Synthetic oligonucleotide
agctgggtc

SEQ ID NO: 930 - DNA, 9 bp, Artificial Sequence
  Synthetic oligonucleotide
agcaacttc

SEQ ID NO: 931 - DNA, 9 bp, Artificial Sequence
  Synthetic oligonucleotide
agctgagtc

SEQ ID NO: 932 - DNA, 9 bp, Artificial Sequence
  Synthetic oligonucleotide
tccagcgtc

SEQ ID NO: 933 - DNA, 9 bp, Artificial Sequence
  Synthetic oligonucleotide
tgcagcgtt

SEQ ID NO: 934 - DNA, 9 bp, Artificial Sequence
  Synthetic oligonucleotide
agcaccttc

SEQ ID NO: 935 - DNA, 9 bp, Artificial Sequence
  Synthetic oligonucleotide
tgcagcggc

SEQ ID NO: 936 - DNA, 9 bp, Artificial Sequence
  Synthetic oligonucleotide
agcagggtt

SEQ ID NO: 937 - DNA, 9 bp, Artificial Sequence
  Synthetic oligonucleotide
agcagcata

SEQ ID NO: 938 - DNA, 9 bp, Artificial Sequence
  Synthetic oligonucleotide
aacagcttc

SEQ ID NO: 939 - DNA, 9 bp, Artificial Sequence
  Synthetic oligonucleotide
tgcagggtc

SEQ ID NO: 940 - DNA, 9 bp, Artificial Sequence
  Synthetic oligonucleotide
agcaaagtc

SEQ ID NO: 941 - DNA, 9 bp, Artificial Sequence
  Synthetic oligonucleotide
aacagcttc

SEQ ID NO: 942 - DNA, 9 bp, Artificial Sequence
  Synthetic oligonucleotide
agtagcggc

SEQ ID NO: 943 - DNA, 9 bp, Artificial Sequence
  Synthetic oligonucleotide
agctgagtc

SEQ ID NO: 944 - DNA, 9 bp, Artificial Sequence
  Synthetic oligonucleotide
agcagcgag

SEQ ID NO: 945 - DNA, 9 bp, Artificial Sequence
  Synthetic oligonucleotide
tgcagtgtc

SEQ ID NO: 946 - DNA, 9 bp, Artificial Sequence
  Synthetic oligonucleotide
agcagcata

SEQ ID NO: 947 - DNA, 9 bp, Artificial Sequence
  Synthetic oligonucleotide
agcagcata

SEQ ID NO: 948 - DNA, 9 bp, Artificial Sequence
  Synthetic oligonucleotide
agcagcggt

SEQ ID NO: 949 - DNA, 9 bp, Artificial Sequence
  Synthetic oligonucleotide
aacagcttc

SEQ ID NO: 950 - DNA, 9 bp, Artificial Sequence
  Synthetic oligonucleotide
ggcagagtc

SEQ ID NO: 951 - DNA, 9 bp, Artificial Sequence
  Synthetic oligonucleotide
agctgtgtc

SEQ ID NO: 952 - DNA, 9 bp, Artificial Sequence
  Synthetic oligonucleotide
agtggcgtc

SEQ ID NO: 953 - DNA, 9 bp, Artificial Sequence
  Synthetic oligonucleotide
agctgtgtc

SEQ ID NO: 954 - DNA, 9 bp, Artificial Sequence
  Synthetic oligonucleotide
agcagcggc

SEQ ID NO: 955 - DNA, 9 bp, Artificial Sequence
  Synthetic oligonucleotide
agcaacgtc

SEQ ID NO: 956 - DNA, 9 bp, Artificial Sequence
  Synthetic oligonucleotide
agcaccgtc

SEQ ID NO: 957 - DNA, 9 bp, Artificial Sequence
  Synthetic oligonucleotide
agcagcggc

SEQ ID NO: 958 - DNA, 9 bp, Artificial Sequence
  Synthetic oligonucleotide
agcagtgtc

SEQ ID NO: 959 - DNA, 9 bp, Artificial Sequence
  Synthetic oligonucleotide
agcaacgtc

SEQ ID NO: 960 - DNA, 9 bp, Artificial Sequence
  Synthetic oligonucleotide
agaaacgtc

SEQ ID NO: 961 - DNA, 9 bp, Artificial Sequence
  Synthetic oligonucleotide
agcatagtc

SEQ ID NO: 962 - DNA, 9 bp, Artificial Sequence
  Synthetic oligonucleotide
agcaacttc

SEQ ID NO: 963 - DNA, 9 bp, Artificial Sequence
  Synthetic oligonucleotide
agcagggtg

SEQ ID NO: 964 - DNA, 9 bp, Artificial Sequence
  Synthetic oligonucleotide
agcacggtc

SEQ ID NO: 965 - DNA, 9 bp, Artificial Sequence
  Synthetic oligonucleotide
agcattgtc

SEQ ID NO: 966 - DNA, 9 bp, Artificial Sequence
  Synthetic oligonucleotide
agcaccgtg

SEQ ID NO: 967 - DNA, 9 bp, Artificial Sequence
  Synthetic oligonucleotide
agcaacttc

SEQ ID NO: 968 - DNA, 9 bp, Artificial Sequence
  Synthetic oligonucleotide
agcaacatc

SEQ ID NO: 969 - DNA, 9 bp, Artificial Sequence
  Synthetic oligonucleotide
ggcagcggc

SEQ ID NO: 970 - DNA, 9 bp, Artificial Sequence
  Synthetic oligonucleotide
agcattgtc

SEQ ID NO: 971 - DNA, 9 bp, Artificial Sequence
  Synthetic oligonucleotide
agcagcagc

SEQ ID NO: 972 - DNA, 9 bp, Artificial Sequence
  Synthetic oligonucleotide
agcagcagc

SEQ ID NO: 973 - DNA, 9 bp, Artificial Sequence
  Synthetic oligonucleotide
atcagagtc

SEQ ID NO: 974 - DNA, 9 bp, Artificial Sequence
  Synthetic oligonucleotide
atcagtgtc

SEQ ID NO: 975 - DNA, 9 bp, Artificial Sequence
  Synthetic oligonucleotide
agcaacatc

SEQ ID NO: 976 - DNA, 9 bp, Artificial Sequence
  Synthetic oligonucleotide
agcatggtc

SEQ ID NO: 977 - DNA, 9 bp, Artificial Sequence
  Synthetic oligonucleotide
agcaaagtc

SEQ ID NO: 978 - DNA, 9 bp, Artificial Sequence
  Synthetic oligonucleotide
agcagctcc

SEQ ID NO: 979 - DNA, 9 bp, Artificial Sequence
  Synthetic oligonucleotide
agcaatgtc

SEQ ID NO: 980 - DNA, 9 bp, Artificial Sequence
  Synthetic oligonucleotide
agtagcgtt

SEQ ID NO: 981 - DNA, 9 bp, Artificial Sequence
  Synthetic oligonucleotide
ggcagagtc

SEQ ID NO: 982 - DNA, 9 bp, Artificial Sequence
  Synthetic oligonucleotide
tgcagcttc

SEQ ID NO: 983 - DNA, 9 bp, Artificial Sequence
  Synthetic oligonucleotide
agcatagtt

SEQ ID NO: 984 - DNA, 9 bp, Artificial Sequence
  Synthetic oligonucleotide
agtaaagtc

SEQ ID NO: 985 - DNA, 9 bp, Artificial Sequence
  Synthetic oligonucleotide
agcattgtt

SEQ ID NO: 986 - DNA, 9 bp, Artificial Sequence
  Synthetic oligonucleotide
tgcagtctc

SEQ ID NO: 987 - DNA, 9 bp, Artificial Sequence
  Synthetic oligonucleotide
agcagcgtc

SEQ ID NO: 988 - DNA, 9 bp, Artificial Sequence
  Synthetic oligonucleotide
agcagcgtg

SEQ ID NO: 989 - DNA, 9 bp, Artificial Sequence
  Synthetic oligonucleotide
agcagcgcc

SEQ ID NO: 990 - DNA, 9 bp, Artificial Sequence
  Synthetic oligonucleotide
agcagcggc

SEQ ID NO: 991 - DNA, 9 bp, Artificial Sequence
  Synthetic oligonucleotide
agcagcttc

SEQ ID NO: 992 - DNA, 9 bp, Artificial Sequence
  Synthetic oligonucleotide
agcagcttc

SEQ ID NO: 993 - DNA, 9 bp, Artificial Sequence
  Synthetic oligonucleotide
atcagcgtc

SEQ ID NO: 994 - DNA, 9 bp, Artificial Sequence
  Synthetic oligonucleotide
agcagcgtg

SEQ ID NO: 995 - DNA, 9 bp, Artificial Sequence
  Synthetic oligonucleotide
agcagggtc

SEQ ID NO: 996 - DNA, 9 bp, Artificial Sequence
  Synthetic oligonucleotide
agcagcgtt

SEQ ID NO: 997 - DNA, 9 bp, Artificial Sequence
  Synthetic oligonucleotide
agcagcggc

SEQ ID NO: 998 - DNA, 9 bp, Artificial Sequence
  Synthetic oligonucleotide
agcagagtc

SEQ ID NO: 999 - DNA, 9 bp, Artificial Sequence
  Synthetic oligonucleotide
agcagagtc

SEQ ID NO: 1000 - DNA, 9 bp, Artificial Sequence
  Synthetic oligonucleotide
agcagggtc

SEQ ID NO: 1001 - DNA, 9 bp, Artificial Sequence
  Synthetic oligonucleotide
agcagcgtg

SEQ ID NO: 1002 - DNA, 9 bp, Artificial Sequence
  Synthetic oligonucleotide
agcagcagc

SEQ ID NO: 1003 - DNA, 9 bp, Artificial Sequence
  Synthetic oligonucleotide
aggagcttc

SEQ ID NO: 1004 - DNA, 9 bp, Artificial Sequence
  Synthetic oligonucleotide
agcagcctg

SEQ ID NO: 1005 - DNA, 9 bp, Artificial Sequence
  Synthetic oligonucleotide
accagtgtc

SEQ ID NO: 1006 - DNA, 9 bp, Artificial Sequence
  Synthetic oligonucleotide
aacagagtc

SEQ ID NO: 1007 - DNA, 9 bp, Artificial Sequence
  Synthetic oligonucleotide
agcagcctg

SEQ ID NO: 1008 - DNA, 9 bp, Artificial Sequence
  Synthetic oligonucleotide
agcagcagc

SEQ ID NO: 1009 - DNA, 9 bp, Artificial Sequence
  Synthetic oligonucleotide
atcagagtc

SEQ ID NO: 1010 - DNA, 9 bp, Artificial Sequence
  Synthetic oligonucleotide
agcggggtc

SEQ ID NO: 1011 - DNA, 9 bp, Artificial Sequence
  Synthetic oligonucleotide
agcagcgga

SEQ ID NO: 1012 - DNA, 9 bp, Artificial Sequence
  Synthetic oligonucleotide
agcagcgtc

SEQ ID NO: 1013 - DNA, 9 bp, Artificial Sequence
  Synthetic oligonucleotide
agcagcgtc

SEQ ID NO: 1014 - DNA, 9 bp, Artificial Sequence
  Synthetic oligonucleotide
agcagcgtc

SEQ ID NO: 1015 - DNA, 9 bp, Artificial Sequence
  Synthetic oligonucleotide
agcagcgtc

SEQ ID NO: 1016 - DNA, 9 bp, Artificial Sequence
  Synthetic oligonucleotide
agcagcgtc

SEQ ID NO: 1017 - DNA, 9 bp, Artificial Sequence
  Synthetic oligonucleotide
agcagcgtc

SEQ ID NO: 1018 - DNA, 9 bp, Artificial Sequence
  Synthetic oligonucleotide
agcagggtc

SEQ ID NO: 1019 - DNA, 9 bp, Artificial Sequence
  Synthetic oligonucleotide
agcagtgtc

SEQ ID NO: 1020 - DNA, 9 bp, Artificial Sequence
  Synthetic oligonucleotide
agcagggtc

SEQ ID NO: 1021 - DNA, 9 bp, Artificial Sequence
  Synthetic oligonucleotide
agcagggtc

SEQ ID NO: 1022 - DNA, 9 bp, Artificial Sequence
  Synthetic oligonucleotide
agcagggtc

SEQ ID NO: 1023 - DNA, 9 bp, Artificial Sequence
  Synthetic oligonucleotide
ggcagcgtc

SEQ ID NO: 1024 - DNA, 9 bp, Artificial Sequence
  Synthetic oligonucleotide
ggcagcgtc

SEQ ID NO: 1025 - DNA, 9 bp, Artificial Sequence
  Synthetic oligonucleotide
agcagggtc

SEQ ID NO: 1026 - DNA, 9 bp, Artificial Sequence
  Synthetic oligonucleotide
agcagagtc

SEQ ID NO: 1027 - DNA, 9 bp, Artificial Sequence
  Synthetic oligonucleotide
agcagcatc

SEQ ID NO: 1028 - DNA, 9 bp, Artificial Sequence
  Synthetic oligonucleotide
agcatcgtc

SEQ ID NO: 1029 - DNA, 9 bp, Artificial Sequence
  Synthetic oligonucleotide
agcagtgtc

SEQ ID NO: 1030 - DNA, 9 bp, Artificial Sequence
  Synthetic oligonucleotide
ggcagcgtc

SEQ ID NO: 1031 - DNA, 9 bp, Artificial Sequence
  Synthetic oligonucleotide
agcagcggc

SEQ ID NO: 1032 - DNA, 9 bp, Artificial Sequence
  Synthetic oligonucleotide
agcagcggc

SEQ ID NO: 1033 - DNA, 9 bp, Artificial Sequence
  Synthetic oligonucleotide
agcagtgtc

SEQ ID NO: 1034 - DNA, 9 bp, Artificial Sequence
  Synthetic oligonucleotide
agcagtgtc

SEQ ID NO: 1035 - DNA, 9 bp, Artificial Sequence
  Synthetic oligonucleotide
agcagtgtc

SEQ ID NO: 1036 - DNA, 9 bp, Artificial Sequence
  Synthetic oligonucleotide
agcagtgtc

SEQ ID NO: 1037 - DNA, 9 bp, Artificial Sequence
  Synthetic oligonucleotide
agcaccgtc

SEQ ID NO: 1038 - DNA, 9 bp, Artificial Sequence
  Synthetic oligonucleotide
agccacgtc

SEQ ID NO: 1039 - DNA, 9 bp, Artificial Sequence
  Synthetic oligonucleotide
agtagcgcc

SEQ ID NO: 1040 - DNA, 9 bp, Artificial Sequence
  Synthetic oligonucleotide
aacagggtc

SEQ ID NO: 1041 - DNA, 9 bp, Artificial Sequence
  Synthetic oligonucleotide
ggcagggtc

SEQ ID NO: 1042 - DNA, 9 bp, Artificial Sequence
  Synthetic oligonucleotide
aacagggtc

SEQ ID NO: 1043 - DNA, 9 bp, Artificial Sequence
  Synthetic oligonucleotide
aggagagtc

SEQ ID NO: 1044 - DNA, 9 bp, Artificial Sequence
  Synthetic oligonucleotide
agcagccgc

SEQ ID NO: 1045 - DNA, 9 bp, Artificial Sequence
  Synthetic oligonucleotide
ggcagagtc

SEQ ID NO: 1046 - DNA, 9 bp, Artificial Sequence
  Synthetic oligonucleotide
agcagtgtg

SEQ ID NO: 1047 - DNA, 9 bp, Artificial Sequence
  Synthetic oligonucleotide
agcatcttc

SEQ ID NO: 1048 - DNA, 9 bp, Artificial Sequence
  Synthetic oligonucleotide
agcagagtg

SEQ ID NO: 1049 - DNA, 9 bp, Artificial Sequence
  Synthetic oligonucleotide
atcagtgtc

SEQ ID NO: 1050 - DNA, 9 bp, Artificial Sequence
  Synthetic oligonucleotide
ttcagcgtc

SEQ ID NO: 1051 - DNA, 9 bp, Artificial Sequence
  Synthetic oligonucleotide
agcaacttc

SEQ ID NO: 1052 - DNA, 9 bp, Artificial Sequence
  Synthetic oligonucleotide
agcagcggg

SEQ ID NO: 1053 - DNA, 9 bp, Artificial Sequence
  Synthetic oligonucleotide
agtagcgtg

SEQ ID NO: 1054 - DNA, 9 bp, Artificial Sequence
  Synthetic oligonucleotide
agctgcatc

SEQ ID NO: 1055 - DNA, 9 bp, Artificial Sequence
  Synthetic oligonucleotide
atcagagtc

SEQ ID NO: 1056 - DNA, 9 bp, Artificial Sequence
  Synthetic oligonucleotide
agcaggatc

SEQ ID NO: 1057 - DNA, 9 bp, Artificial Sequence
  Synthetic oligonucleotide
agccacgtc

SEQ ID NO: 1058 - DNA, 9 bp, Artificial Sequence
  Synthetic oligonucleotide
agcaatgtc

SEQ ID NO: 1059 - DNA, 9 bp, Artificial Sequence
  Synthetic oligonucleotide
agcaatgtc

SEQ ID NO: 1060 - DNA, 9 bp, Artificial Sequence
  Synthetic oligonucleotide
ggctgcgtc

SEQ ID NO: 1061 - DNA, 9 bp, Artificial Sequence
  Synthetic oligonucleotide
ggcagagtc

SEQ ID NO: 1062 - DNA, 9 bp, Artificial Sequence
  Synthetic oligonucleotide
agcagtgtg

SEQ ID NO: 1063 - DNA, 9 bp, Artificial Sequence
  Synthetic oligonucleotide
ggcaacatc

SEQ ID NO: 1064 - DNA, 9 bp, Artificial Sequence
  Synthetic oligonucleotide
cccagcggc

SEQ ID NO: 1065 - DNA, 9 bp, Artificial Sequence
  Synthetic oligonucleotide
agcctggtc

SEQ ID NO: 1066 - DNA, 9 bp, Artificial Sequence
  Synthetic oligonucleotide
tgcagtctc

SEQ ID NO: 1067 - DNA, 9 bp, Artificial Sequence
  Synthetic oligonucleotide
agcattgta

SEQ ID NO: 1068 - DNA, 9 bp, Artificial Sequence
  Synthetic oligonucleotide
agcctggtc

SEQ ID NO: 1069 - DNA, 9 bp, Artificial Sequence
  Synthetic oligonucleotide
agcatagtg

SEQ ID NO: 1070 - DNA, 9 bp, Artificial Sequence
  Synthetic oligonucleotide
agcaaaggc

SEQ ID NO: 1071 - DNA, 9 bp, Artificial Sequence
  Synthetic oligonucleotide
aacatggtc

SEQ ID NO: 1072 - DNA, 9 bp, Artificial Sequence
  Synthetic oligonucleotide
agctttgtc

SEQ ID NO: 1073 - DNA, 9 bp, Artificial Sequence
  Synthetic oligonucleotide
agcaaaggc

SEQ ID NO: 1074 - DNA, 9 bp, Artificial Sequence
  Synthetic oligonucleotide
atcaaggtc

SEQ ID NO: 1075 - DNA, 9 bp, Artificial Sequence
  Synthetic oligonucleotide
gccagtgtc

SEQ ID NO: 1076 - DNA, 9 bp, Artificial Sequence
  Synthetic oligonucleotide
tgcaaagtc

SEQ ID NO: 1077 - DNA, 9 bp, Artificial Sequence
  Synthetic oligonucleotide
agcaacgtc

SEQ ID NO: 1078 - DNA, 9 bp, Artificial Sequence
  Synthetic oligonucleotide
agcaacgtc

SEQ ID NO: 1079 - DNA, 9 bp, Artificial Sequence
  Synthetic oligonucleotide
ggcagtgtc

SEQ ID NO: 1080 - DNA, 9 bp, Artificial Sequence
  Synthetic oligonucleotide
agcaaagtc

SEQ ID NO: 1081 - DNA, 9 bp, Artificial Sequence
  Synthetic oligonucleotide
tgctgtgtc

SEQ ID NO: 1082 - DNA, 9 bp, Artificial Sequence
  Synthetic oligonucleotide
ggcaaggtc

SEQ ID NO: 1083 - DNA, 9 bp, Artificial Sequence
  Synthetic oligonucleotide
atcaacgtg

SEQ ID NO: 1084 - DNA, 9 bp, Artificial Sequence
  Synthetic oligonucleotide
agcagcgtc

SEQ ID NO: 1085 - DNA, 9 bp, Artificial Sequence
  Synthetic oligonucleotide
agcagcgtc

SEQ ID NO: 1086 - DNA, 9 bp, Artificial Sequence
  Synthetic oligonucleotide
agcagagtc

SEQ ID NO: 1087 - DNA, 9 bp, Artificial Sequence
  Synthetic oligonucleotide
agcagcttc

SEQ ID NO: 1088 - DNA, 9 bp, Artificial Sequence
  Synthetic oligonucleotide
ggcagcgtc

SEQ ID NO: 1089 - DNA, 9 bp, Artificial Sequence
  Synthetic oligonucleotide
agcagtgtc

SEQ ID NO: 1090 - DNA, 9 bp, Artificial Sequence
  Synthetic oligonucleotide
agcagcttc

SEQ ID NO: 1091 - DNA, 9 bp, Artificial Sequence
  Synthetic oligonucleotide
agcagctgc

SEQ ID NO: 1092 - DNA, 9 bp, Artificial Sequence
  Synthetic oligonucleotide
agcagtggc

SEQ ID NO: 1093 - DNA, 9 bp, Artificial Sequence
  Synthetic oligonucleotide
agcagcatg

SEQ ID NO: 1094 - DNA, 9 bp, Artificial Sequence
  Synthetic oligonucleotide
agcagcatg

SEQ ID NO: 1095 - DNA, 9 bp, Artificial Sequence
  Synthetic oligonucleotide
accagggtc

SEQ ID NO: 1096 - DNA, 9 bp, Artificial Sequence
  Synthetic oligonucleotide
agcagcatg

SEQ ID NO: 1097 - DNA, 9 bp, Artificial Sequence
  Synthetic oligonucleotide
agcagggtg

SEQ ID NO: 1098 - DNA, 9 bp, Artificial Sequence
  Synthetic oligonucleotide
agcagtgac

SEQ ID NO: 1099 - DNA, 9 bp, Artificial Sequence
  Synthetic oligonucleotide
agcagattc

SEQ ID NO: 1100 - DNA, 9 bp, Artificial Sequence
  Synthetic oligonucleotide
atcagcgtg

SEQ ID NO: 1101 - DNA, 9 bp, Artificial Sequence
  Synthetic oligonucleotide
agcaggggc

SEQ ID NO: 1102 - DNA, 9 bp, Artificial Sequence
  Synthetic oligonucleotide
agcgccgtc

SEQ ID NO: 1103 - DNA, 9 bp, Artificial Sequence
  Synthetic oligonucleotide
agcagcgtc

SEQ ID NO: 1104 - DNA, 9 bp, Artificial Sequence
  Synthetic oligonucleotide
agcagcgtc

SEQ ID NO: 1105 - DNA, 9 bp, Artificial Sequence
  Synthetic oligonucleotide
agcagcgtc

SEQ ID NO: 1106 - DNA, 9 bp, Artificial Sequence
  Synthetic oligonucleotide
agcagcggc

SEQ ID NO: 1107 - DNA, 9 bp, Artificial Sequence
  Synthetic oligonucleotide
agcagagtc

SEQ ID NO: 1108 - DNA, 9 bp, Artificial Sequence
  Synthetic oligonucleotide
tgcagcgtc

SEQ ID NO: 1109 - DNA, 9 bp, Artificial Sequence
  Synthetic oligonucleotide
agcagcgtg

SEQ ID NO: 1110 - DNA, 9 bp, Artificial Sequence
  Synthetic oligonucleotide
agcagcttc

SEQ ID NO: 1111 - DNA, 9 bp, Artificial Sequence
  Synthetic oligonucleotide
agcagcatc

SEQ ID NO: 1112 - DNA, 9 bp, Artificial Sequence
  Synthetic oligonucleotide
agcaacgtc

SEQ ID NO: 1113 - DNA, 9 bp, Artificial Sequence
  Synthetic oligonucleotide
agcagcggc

SEQ ID NO: 1114 - DNA, 9 bp, Artificial Sequence
  Synthetic oligonucleotide
agcaacgtc

SEQ ID NO: 1115 - DNA, 9 bp, Artificial Sequence
  Synthetic oligonucleotide
agtagcgtc

SEQ ID NO: 1116 - DNA, 9 bp, Artificial Sequence
  Synthetic oligonucleotide
agcagcgtt

SEQ ID NO: 1117 - DNA, 9 bp, Artificial Sequence
  Synthetic oligonucleotide
agcagcggc

SEQ ID NO: 1118 - DNA, 9 bp, Artificial Sequence
  Synthetic oligonucleotide
agcaaggtc

SEQ ID NO: 1119 - DNA, 9 bp, Artificial Sequence
  Synthetic oligonucleotide
agcatggtc

SEQ ID NO: 1120 - DNA, 9 bp, Artificial Sequence
  Synthetic oligonucleotide
agtagggtc

SEQ ID NO: 1121 - DNA, 9 bp, Artificial Sequence
  Synthetic oligonucleotide
atcagggtc

SEQ ID NO: 1122 - DNA, 9 bp, Artificial Sequence
  Synthetic oligonucleotide
agcatggtc

SEQ ID NO: 1123 - DNA, 9 bp, Artificial Sequence
  Synthetic oligonucleotide
agcagggta

SEQ ID NO: 1124 - DNA, 9 bp, Artificial Sequence
  Synthetic oligonucleotide
ggcaacgtc

SEQ ID NO: 1125 - DNA, 9 bp, Artificial Sequence
  Synthetic oligonucleotide
gccagcgtc

SEQ ID NO: 1126 - DNA, 9 bp, Artificial Sequence
  Synthetic oligonucleotide
agcagcttt

SEQ ID NO: 1127 - DNA, 9 bp, Artificial Sequence
  Synthetic oligonucleotide
agcagtggc

SEQ ID NO: 1128 - DNA, 9 bp, Artificial Sequence
  Synthetic oligonucleotide
ggcagcatc

SEQ ID NO: 1129 - DNA, 9 bp, Artificial Sequence
  Synthetic oligonucleotide
ggcagcatc

SEQ ID NO: 1130 - DNA, 9 bp, Artificial Sequence
  Synthetic oligonucleotide
agcagtgta

SEQ ID NO: 1131 - DNA, 9 bp, Artificial Sequence
  Synthetic oligonucleotide
aggagagtc

SEQ ID NO: 1132 - DNA, 9 bp, Artificial Sequence
  Synthetic oligonucleotide
agcatggtc

SEQ ID NO: 1133 - DNA, 9 bp, Artificial Sequence
  Synthetic oligonucleotide
atcagggtc

SEQ ID NO: 1134 - DNA, 9 bp, Artificial Sequence
  Synthetic oligonucleotide
aacagcgtg

SEQ ID NO: 1135 - DNA, 9 bp, Artificial Sequence
  Synthetic oligonucleotide
agtagcttc

SEQ ID NO: 1136 - DNA, 9 bp, Artificial Sequence
  Synthetic oligonucleotide
agcaacttc

SEQ ID NO: 1137 - DNA, 9 bp, Artificial Sequence
  Synthetic oligonucleotide
agcatggtc

SEQ ID NO: 1138 - DNA, 9 bp, Artificial Sequence
  Synthetic oligonucleotide
agaagtgtc

SEQ ID NO: 1139 - DNA, 9 bp, Artificial Sequence
  Synthetic oligonucleotide
aacagcggc

SEQ ID NO: 1140 - DNA, 9 bp, Artificial Sequence
  Synthetic oligonucleotide
agcagtggc

SEQ ID NO: 1141 - DNA, 9 bp, Artificial Sequence
  Synthetic oligonucleotide
aaaagtgtc

SEQ ID NO: 1142 - DNA, 9 bp, Artificial Sequence
  Synthetic oligonucleotide
agcaatggc

SEQ ID NO: 1143 - DNA, 9 bp, Artificial Sequence
  Synthetic oligonucleotide
gccaccgtc

SEQ ID NO: 1144 - DNA, 9 bp, Artificial Sequence
  Synthetic oligonucleotide
aaaagtgtc

SEQ ID NO: 1145 - DNA, 9 bp, Artificial Sequence
  Synthetic oligonucleotide
aacattgtc

SEQ ID NO: 1146 - DNA, 9 bp, Artificial Sequence
  Synthetic oligonucleotide
aacattgtc

SEQ ID NO: 1147 - DNA, 9 bp, Artificial Sequence
  Synthetic oligonucleotide
aacattgtc

SEQ ID NO: 1148 - DNA, 9 bp, Artificial Sequence
  Synthetic oligonucleotide
aacattgtc

SEQ ID NO: 1149 - DNA, 9 bp, Artificial Sequence
  Synthetic oligonucleotide
aacattgtc

SEQ ID NO: 1150 - DNA, 9 bp, Artificial Sequence
  Synthetic oligonucleotide
aacattgtc

SEQ ID NO: 1151 - DNA, 9 bp, Artificial Sequence
  Synthetic oligonucleotide
aacattgtc

SEQ ID NO: 1152 - DNA, 9 bp, Artificial Sequence
  Synthetic oligonucleotide
aacattgtc

SEQ ID NO: 1153 - DNA, 9 bp, Artificial Sequence
  Synthetic oligonucleotide
aacattgtc

SEQ ID NO: 1154 - DNA, 9 bp, Artificial Sequence
  Synthetic oligonucleotide
aacattgtc

SEQ ID NO: 1155 - DNA, 9 bp, Artificial Sequence
  Synthetic oligonucleotide
aacattgtc

SEQ ID NO: 1156 - DNA, 9 bp, Artificial Sequence
  Synthetic oligonucleotide
aacattgtc

SEQ ID NO: 1157 - DNA, 9 bp, Artificial Sequence
  Synthetic oligonucleotide
aacattgtc

SEQ ID NO: 1158 - DNA, 9 bp, Artificial Sequence
  Synthetic oligonucleotide
aacattgtc

SEQ ID NO: 1159 - DNA, 9 bp, Artificial Sequence
  Synthetic oligonucleotide
atcaacttc

SEQ ID NO: 1160 - DNA, 9 bp, Artificial Sequence
  Synthetic oligonucleotide
agcatggtg

SEQ ID NO: 1161 - DNA, 9 bp, Artificial Sequence
  Synthetic oligonucleotide
agtagtctc

SEQ ID NO: 1162 - DNA, 9 bp, Artificial Sequence
  Synthetic oligonucleotide
agcattgtt

SEQ ID NO: 1163 - DNA, 9 bp, Artificial Sequence
  Synthetic oligonucleotide
agcaaggtt

SEQ ID NO: 1164 - DNA, 9 bp, Artificial Sequence
  Synthetic oligonucleotide
agcagtctt

SEQ ID NO: 1165 - DNA, 9 bp, Artificial Sequence
  Synthetic oligonucleotide
agcattgtt

SEQ ID NO: 1166 - DNA, 9 bp, Artificial Sequence
  Synthetic oligonucleotide
agcagcgtc

SEQ ID NO: 1167 - DNA, 9 bp, Artificial Sequence
  Synthetic oligonucleotide
agcagcgtc

SEQ ID NO: 1168 - DNA, 9 bp, Artificial Sequence
  Synthetic oligonucleotide
ggcagcgtc

SEQ ID NO: 1169 - DNA, 9 bp, Artificial Sequence
  Synthetic oligonucleotide
agcagagtc

SEQ ID NO: 1170 - DNA, 9 bp, Artificial Sequence
  Synthetic oligonucleotide
agcagcatc

SEQ ID NO: 1171 - DNA, 9 bp, Artificial Sequence
  Synthetic oligonucleotide
agcagagtc

SEQ ID NO: 1172 - DNA, 9 bp, Artificial Sequence
  Synthetic oligonucleotide
agcagtgtc

SEQ ID NO: 1173 - DNA, 9 bp, Artificial Sequence
  Synthetic oligonucleotide
agcagcatc

SEQ ID NO: 1174 - DNA, 9 bp, Artificial Sequence
  Synthetic oligonucleotide
agctgcgtc

SEQ ID NO: 1175 - DNA, 9 bp, Artificial Sequence
  Synthetic oligonucleotide
agcagcttc

SEQ ID NO: 1176 - DNA, 9 bp, Artificial Sequence
  Synthetic oligonucleotide
agcagggtc

SEQ ID NO: 1177 - DNA, 9 bp, Artificial Sequence
  Synthetic oligonucleotide
agcagggtc

SEQ ID NO: 1178 - DNA, 9 bp, Artificial Sequence
  Synthetic oligonucleotide
agcagcatc

SEQ ID NO: 1179 - DNA, 9 bp, Artificial Sequence
  Synthetic oligonucleotide
agcagagtc

SEQ ID NO: 1180 - DNA, 9 bp, Artificial Sequence
  Synthetic oligonucleotide
agcagcctc

SEQ ID NO: 1181 - DNA, 9 bp, Artificial Sequence
  Synthetic oligonucleotide
agcagcctc

SEQ ID NO: 1182 - DNA, 9 bp, Artificial Sequence
  Synthetic oligonucleotide
agcagcttc

SEQ ID NO: 1183 - DNA, 9 bp, Artificial Sequence
  Synthetic oligonucleotide
agcagcctc

SEQ ID NO: 1184 - DNA, 9 bp, Artificial Sequence
  Synthetic oligonucleotide
agcagcatc

SEQ ID NO: 1185 - DNA, 9 bp, Artificial Sequence
  Synthetic oligonucleotide
agcagcgtg

SEQ ID NO: 1186 - DNA, 9 bp, Artificial Sequence
  Synthetic oligonucleotide
agcagcatc

SEQ ID NO: 1187 - DNA, 9 bp, Artificial Sequence
  Synthetic oligonucleotide
agcagcatc

SEQ ID NO: 1188 - DNA, 9 bp, Artificial Sequence
  Synthetic oligonucleotide
agcagagtc

SEQ ID NO: 1189 - DNA, 9 bp, Artificial Sequence
  Synthetic oligonucleotide
ggcagcgtc

SEQ ID NO: 1190 - DNA, 9 bp, Artificial Sequence
  Synthetic oligonucleotide
agcagcgcc

SEQ ID NO: 1191 - DNA, 9 bp, Artificial Sequence
  Synthetic oligonucleotide
agctgcgtc

SEQ ID NO: 1192 - DNA, 9 bp, Artificial Sequence
  Synthetic oligonucleotide
agcagggtc

SEQ ID NO: 1193 - DNA, 9 bp, Artificial Sequence
  Synthetic oligonucleotide
agcagagtc

SEQ ID NO: 1194 - DNA, 9 bp, Artificial Sequence
  Synthetic oligonucleotide
agcagagtc

SEQ ID NO: 1195 - DNA, 9 bp, Artificial Sequence
  Synthetic oligonucleotide
agcagtgtc

SEQ ID NO: 1196 - DNA, 9 bp, Artificial Sequence
  Synthetic oligonucleotide
agcagtgtc

SEQ ID NO: 1197 - DNA, 9 bp, Artificial Sequence
  Synthetic oligonucleotide
agcagcatc

SEQ ID NO: 1198 - DNA, 9 bp, Artificial Sequence
  Synthetic oligonucleotide
aacagcgtc

SEQ ID NO: 1199 - DNA, 9 bp, Artificial Sequence
  Synthetic oligonucleotide
agcagcgcc

SEQ ID NO: 1200 - DNA, 9 bp, Artificial Sequence
  Synthetic oligonucleotide
agcagcgcc

SEQ ID NO: 1201 - DNA, 9 bp, Artificial Sequence
  Synthetic oligonucleotide
agcagcgcc

SEQ ID NO: 1202 - DNA, 9 bp, Artificial Sequence
  Synthetic oligonucleotide
agcagcgcc

SEQ ID NO: 1203 - DNA, 9 bp, Artificial Sequence
  Synthetic oligonucleotide
agcagcgcc

SEQ ID NO: 1204 - DNA, 9 bp, Artificial Sequence
  Synthetic oligonucleotide
agcagcgcc

SEQ ID NO: 1205 - DNA, 9 bp, Artificial Sequence
  Synthetic oligonucleotide
agcagcgcc

SEQ ID NO: 1206 - DNA, 9 bp, Artificial Sequence
  Synthetic oligonucleotide
agcagcgcc

SEQ ID NO: 1207 - DNA, 9 bp, Artificial Sequence
  Synthetic oligonucleotide
agcagcatc

SEQ ID NO: 1208 - DNA, 9 bp, Artificial Sequence
  Synthetic oligonucleotide
agcagagtc

SEQ ID NO: 1209 - DNA, 9 bp, Artificial Sequence
  Synthetic oligonucleotide
agcagcctc

SEQ ID NO: 1210 - DNA, 9 bp, Artificial Sequence
  Synthetic oligonucleotide
agcagcatc

SEQ ID NO: 1211 - DNA, 9 bp, Artificial Sequence
  Synthetic oligonucleotide
agcagtgtc

SEQ ID NO: 1212 - DNA, 9 bp, Artificial Sequence
  Synthetic oligonucleotide
agcagagtc

SEQ ID NO: 1213 - DNA, 9 bp, Artificial Sequence
  Synthetic oligonucleotide
agcagcgtg

SEQ ID NO: 1214 - DNA, 9 bp, Artificial Sequence
  Synthetic oligonucleotide
accagcgtc

SEQ ID NO: 1215 - DNA, 9 bp, Artificial Sequence
  Synthetic oligonucleotide
agcagtgtc

SEQ ID NO: 1216 - DNA, 9 bp, Artificial Sequence
  Synthetic oligonucleotide
agcagcgac

SEQ ID NO: 1217 - DNA, 9 bp, Artificial Sequence
  Synthetic oligonucleotide
agcagtgtc

SEQ ID NO: 1218 - DNA, 9 bp, Artificial Sequence
  Synthetic oligonucleotide
agcagcgta

SEQ ID NO: 1219 - DNA, 9 bp, Artificial Sequence
  Synthetic oligonucleotide
agcagcctc

SEQ ID NO: 1220 - DNA, 9 bp, Artificial Sequence
  Synthetic oligonucleotide
agcagagtc

SEQ ID NO: 1221 - DNA, 9 bp, Artificial Sequence
  Synthetic oligonucleotide
tgcagcgtc

SEQ ID NO: 1222 - DNA, 9 bp, Artificial Sequence
  Synthetic oligonucleotide
agcagggac

SEQ ID NO: 1223 - DNA, 9 bp, Artificial Sequence
  Synthetic oligonucleotide
agcaggctc

SEQ ID NO: 1224 - DNA, 9 bp, Artificial Sequence
  Synthetic oligonucleotide
agcagccta

SEQ ID NO: 1225 - DNA, 9 bp, Artificial Sequence
  Synthetic oligonucleotide
agcatcctc

SEQ ID NO: 1226 - DNA, 9 bp, Artificial Sequence
  Synthetic oligonucleotide
agcagagta

SEQ ID NO: 1227 - DNA, 9 bp, Artificial Sequence
  Synthetic oligonucleotide
agcagggta

SEQ ID NO: 1228 - DNA, 9 bp, Artificial Sequence
  Synthetic oligonucleotide
agcagagac

SEQ ID NO: 1229 - DNA, 9 bp, Artificial Sequence
  Synthetic oligonucleotide
agcagagtg

SEQ ID NO: 1230 - DNA, 9 bp, Artificial Sequence
  Synthetic oligonucleotide
agctgcctc

SEQ ID NO: 1231 - DNA, 9 bp, Artificial Sequence
  Synthetic oligonucleotide
aggagggtc

SEQ ID NO: 1232 - DNA, 9 bp, Artificial Sequence
  Synthetic oligonucleotide
agcagactc

SEQ ID NO: 1233 - DNA, 9 bp, Artificial Sequence
  Synthetic oligonucleotide
agcagagta

SEQ ID NO: 1234 - DNA, 9 bp, Artificial Sequence
  Synthetic oligonucleotide
agcagagtt

SEQ ID NO: 1235 - DNA, 9 bp, Artificial Sequence
  Synthetic oligonucleotide
agcagcacc

SEQ ID NO: 1236 - DNA, 9 bp, Artificial Sequence
  Synthetic oligonucleotide
agcaggatc

SEQ ID NO: 1237 - DNA, 9 bp, Artificial Sequence
  Synthetic oligonucleotide
tgcagcatc

SEQ ID NO: 1238 - DNA, 9 bp, Artificial Sequence
  Synthetic oligonucleotide
agcagagtg

SEQ ID NO: 1239 - DNA, 9 bp, Artificial Sequence
  Synthetic oligonucleotide
agcagtgcc

SEQ ID NO: 1240 - DNA, 9 bp, Artificial Sequence
  Synthetic oligonucleotide
agcagagta

SEQ ID NO: 1241 - DNA, 9 bp, Artificial Sequence
  Synthetic oligonucleotide
agcagagtg

SEQ ID NO: 1242 - DNA, 9 bp, Artificial Sequence
  Synthetic oligonucleotide
agcaggatc

SEQ ID NO: 1243 - DNA, 9 bp, Artificial Sequence
  Synthetic oligonucleotide
agcagcttg

SEQ ID NO: 1244 - DNA, 9 bp, Artificial Sequence
  Synthetic oligonucleotide
agcagagta

SEQ ID NO: 1245 - DNA, 9 bp, Artificial Sequence
  Synthetic oligonucleotide
agcagcgtc

SEQ ID NO: 1246 - DNA, 9 bp, Artificial Sequence
  Synthetic oligonucleotide
agcagcgtc

SEQ ID NO: 1247 - DNA, 9 bp, Artificial Sequence
  Synthetic oligonucleotide
agcagcgtc

SEQ ID NO: 1248 - DNA, 9 bp, Artificial Sequence
  Synthetic oligonucleotide
agcagcgtc

SEQ ID NO: 1249 - DNA, 9 bp, Artificial Sequence
  Synthetic oligonucleotide
agcagcgtc

SEQ ID NO: 1250 - DNA, 9 bp, Artificial Sequence
  Synthetic oligonucleotide
agcagcgtc

SEQ ID NO: 1251 - DNA, 9 bp, Artificial Sequence
  Synthetic oligonucleotide
agcagcgtc

SEQ ID NO: 1252 - DNA, 9 bp, Artificial Sequence
  Synthetic oligonucleotide
agcagcgtc

SEQ ID NO: 1253 - DNA, 9 bp, Artificial Sequence
  Synthetic oligonucleotide
agcagcgtc

SEQ ID NO: 1254 - DNA, 9 bp, Artificial Sequence
  Synthetic oligonucleotide
agcagcgtc

SEQ ID NO: 1255 - DNA, 9 bp, Artificial Sequence
  Synthetic oligonucleotide
agcagcgtc

SEQ ID NO: 1256 - DNA, 9 bp, Artificial Sequence
  Synthetic oligonucleotide
agcagcgtc

SEQ ID NO: 1257 - DNA, 9 bp, Artificial Sequence
  Synthetic oligonucleotide
agcagcgtc

SEQ ID NO: 1258 - DNA, 9 bp, Artificial Sequence
  Synthetic oligonucleotide
agcagcgtc

SEQ ID NO: 1259 - DNA, 9 bp, Artificial Sequence
  Synthetic oligonucleotide
agcagcgtc

SEQ ID NO: 1260 - DNA, 9 bp, Artificial Sequence
  Synthetic oligonucleotide
agcagcgtc

SEQ ID NO: 1261 - DNA, 9 bp, Artificial Sequence
  Synthetic oligonucleotide
agcagcgtc

SEQ ID NO: 1262 - DNA, 9 bp, Artificial Sequence
  Synthetic oligonucleotide
agcagcgtc

SEQ ID NO: 1263 - DNA, 9 bp, Artificial Sequence
  Synthetic oligonucleotide
agcagcgtc

SEQ ID NO: 1264 - DNA, 9 bp, Artificial Sequence
  Synthetic oligonucleotide
agcagcgtc

SEQ ID NO: 1265 - DNA, 9 bp, Artificial Sequence
  Synthetic oligonucleotide
agcagcgtc

SEQ ID NO: 1266 - DNA, 9 bp, Artificial Sequence
  Synthetic oligonucleotide
agcagcgtc

SEQ ID NO: 1267 - DNA, 9 bp, Artificial Sequence
  Synthetic oligonucleotide
agcagcgtc

SEQ ID NO: 1268 - DNA, 9 bp, Artificial Sequence
  Synthetic oligonucleotide
agcagcgtc

SEQ ID NO: 1269 - DNA, 9 bp, Artificial Sequence
  Synthetic oligonucleotide
agcagcgtc

SEQ ID NO: 1270 - DNA, 9 bp, Artificial Sequence
  Synthetic oligonucleotide
agcagcgtc

SEQ ID NO: 1271 - DNA, 9 bp, Artificial Sequence
  Synthetic oligonucleotide
agcagcgtc

SEQ ID NO: 1272 - DNA, 9 bp, Artificial Sequence
  Synthetic oligonucleotide
agcagcgtc

SEQ ID NO: 1273 - DNA, 9 bp, Artificial Sequence
  Synthetic oligonucleotide
agcagcgtc

SEQ ID NO: 1274 - DNA, 9 bp, Artificial Sequence
  Synthetic oligonucleotide
agcagcgtc

SEQ ID NO: 1275 - DNA, 9 bp, Artificial Sequence
  Synthetic oligonucleotide
agcagcgtc

SEQ ID NO: 1276 - DNA, 9 bp, Artificial Sequence
  Synthetic oligonucleotide
agcagcgtc

SEQ ID NO: 1277 - DNA, 9 bp, Artificial Sequence
  Synthetic oligonucleotide
agcagcgtc

SEQ ID NO: 1278 - DNA, 9 bp, Artificial Sequence
  Synthetic oligonucleotide
agcagcgtc

SEQ ID NO: 1279 - DNA, 9 bp, Artificial Sequence
  Synthetic oligonucleotide
agcagcgtc

SEQ ID NO: 1280 - DNA, 9 bp, Artificial Sequence
  Synthetic oligonucleotide
agcagcgtc

SEQ ID NO: 1281 - DNA, 9 bp, Artificial Sequence
  Synthetic oligonucleotide
agcagcgtc

SEQ ID NO: 1282 - DNA, 9 bp, Artificial Sequence
  Synthetic oligonucleotide
agcagcgtc

SEQ ID NO: 1283 - DNA, 9 bp, Artificial Sequence
  Synthetic oligonucleotide
agcagcgtc

SEQ ID NO: 1284 - DNA, 9 bp, Artificial Sequence
  Synthetic oligonucleotide
agcagcgtc

SEQ ID NO: 1285 - DNA, 9 bp, Artificial Sequence
  Synthetic oligonucleotide
agcagcgtc

SEQ ID NO: 1286 - DNA, 9 bp, Artificial Sequence
  Synthetic oligonucleotide
agcagcgtc

SEQ ID NO: 1287 - DNA, 9 bp, Artificial Sequence
  Synthetic oligonucleotide
agcagcgtc

SEQ ID NO: 1288 - DNA, 9 bp, Artificial Sequence
  Synthetic oligonucleotide
agcagcgtc

SEQ ID NO: 1289 - DNA, 9 bp, Artificial Sequence
  Synthetic oligonucleotide
agcagcgtc

SEQ ID NO: 1290 - DNA, 9 bp, Artificial Sequence
  Synthetic oligonucleotide
agcagcgtc

SEQ ID NO: 1291 - DNA, 9 bp, Artificial Sequence
  Synthetic oligonucleotide
agcagcgtc

SEQ ID NO: 1292 - DNA, 9 bp, Artificial Sequence
  Synthetic oligonucleotide
agcagcgtc

SEQ ID NO: 1293 - DNA, 9 bp, Artificial Sequence
  Synthetic oligonucleotide
agcagcgtc

SEQ ID NO: 1294 - DNA, 9 bp, Artificial Sequence
  Synthetic oligonucleotide
agcagcgtc

SEQ ID NO: 1295 - DNA, 9 bp, Artificial Sequence
  Synthetic oligonucleotide
agcagcgtc

SEQ ID NO: 1296 - DNA, 9 bp, Artificial Sequence
  Synthetic oligonucleotide
agcagcgtc

SEQ ID NO: 1297 - DNA, 9 bp, Artificial Sequence
  Synthetic oligonucleotide
agcagcgtc

SEQ ID NO: 1298 - DNA, 9 bp, Artificial Sequence
  Synthetic oligonucleotide
agcagcgtc

SEQ ID NO: 1299 - DNA, 9 bp, Artificial Sequence
  Synthetic oligonucleotide
agcagcgtc

SEQ ID NO: 1300 - DNA, 9 bp, Artificial Sequence
  Synthetic oligonucleotide
agcagcgtc

SEQ ID NO: 1301 - DNA, 9 bp, Artificial Sequence
  Synthetic oligonucleotide
agtagcgtc

SEQ ID NO: 1302 - DNA, 9 bp, Artificial Sequence
  Synthetic oligonucleotide
agcagcttc

SEQ ID NO: 1303 - DNA, 9 bp, Artificial Sequence
  Synthetic oligonucleotide
agcagggtc

SEQ ID NO: 1304 - DNA, 9 bp, Artificial Sequence
  Synthetic oligonucleotide
agcagcatc

SEQ ID NO: 1305 - DNA, 9 bp, Artificial Sequence
  Synthetic oligonucleotide
agcagggtc

SEQ ID NO: 1306 - DNA, 9 bp, Artificial Sequence
  Synthetic oligonucleotide
agcagcggc

SEQ ID NO: 1307 - DNA, 9 bp, Artificial Sequence
  Synthetic oligonucleotide
ggcagcgtc

SEQ ID NO: 1308 - DNA, 9 bp, Artificial Sequence
  Synthetic oligonucleotide
agcagtgtc

SEQ ID NO: 1309 - DNA, 9 bp, Artificial Sequence
  Synthetic oligonucleotide
agcagggtc

SEQ ID NO: 1310 - DNA, 9 bp, Artificial Sequence
  Synthetic oligonucleotide
agcagtgtc

SEQ ID NO: 1311 - DNA, 9 bp, Artificial Sequence
  Synthetic oligonucleotide
agcaccgtc

SEQ ID NO: 1312 - DNA, 9 bp, Artificial Sequence
  Synthetic oligonucleotide
agcagcatc

SEQ ID NO: 1313 - DNA, 9 bp, Artificial Sequence
  Synthetic oligonucleotide
agcagcctc

SEQ ID NO: 1314 - DNA, 9 bp, Artificial Sequence
  Synthetic oligonucleotide
ggcagcgtc

SEQ ID NO: 1315 - DNA, 9 bp, Artificial Sequence
  Synthetic oligonucleotide
agcaacgtc

SEQ ID NO: 1316 - DNA, 9 bp, Artificial Sequence
  Synthetic oligonucleotide
agcaacgtc

SEQ ID NO: 1317 - DNA, 9 bp, Artificial Sequence
  Synthetic oligonucleotide
agcagggtc

SEQ ID NO: 1318 - DNA, 9 bp, Artificial Sequence
  Synthetic oligonucleotide
agcagggtc

SEQ ID NO: 1319 - DNA, 9 bp, Artificial Sequence
  Synthetic oligonucleotide
agcagtgtc

SEQ ID NO: 1320 - DNA, 9 bp, Artificial Sequence
  Synthetic oligonucleotide
agcagggtc

SEQ ID NO: 1321 - DNA, 9 bp, Artificial Sequence
  Synthetic oligonucleotide
agcagcgta

SEQ ID NO: 1322 - DNA, 9 bp, Artificial Sequence
  Synthetic oligonucleotide
agcagcttc

SEQ ID NO: 1323 - DNA, 9 bp, Artificial Sequence
  Synthetic oligonucleotide
agcagcggc

SEQ ID NO: 1324 - DNA, 9 bp, Artificial Sequence
  Synthetic oligonucleotide
agcagtgtc

SEQ ID NO: 1325 - DNA, 9 bp, Artificial Sequence
  Synthetic oligonucleotide
agcagggtc

SEQ ID NO: 1326 - DNA, 9 bp, Artificial Sequence
  Synthetic oligonucleotide
agcagcttc

SEQ ID NO: 1327 - DNA, 9 bp, Artificial Sequence
  Synthetic oligonucleotide
agcaccgtc

SEQ ID NO: 1328 - DNA, 9 bp, Artificial Sequence
  Synthetic oligonucleotide
agcatcgtc

SEQ ID NO: 1329 - DNA, 9 bp, Artificial Sequence
  Synthetic oligonucleotide
agcagggtc

SEQ ID NO: 1330 - DNA, 9 bp, Artificial Sequence
  Synthetic oligonucleotide
agcagagtc

SEQ ID NO: 1331 - DNA, 9 bp, Artificial Sequence
  Synthetic oligonucleotide
agcagcgtg

SEQ ID NO: 1332 - DNA, 9 bp, Artificial Sequence
  Synthetic oligonucleotide
agcaccgtc

SEQ ID NO: 1333 - DNA, 9 bp, Artificial Sequence
  Synthetic oligonucleotide
agcagcttc

SEQ ID NO: 1334 - DNA, 9 bp, Artificial Sequence
  Synthetic oligonucleotide
agcagagtc

SEQ ID NO: 1335 - DNA, 9 bp, Artificial Sequence
  Synthetic oligonucleotide
agcagcttc

SEQ ID NO: 1336 - DNA, 9 bp, Artificial Sequence
  Synthetic oligonucleotide
agcagcttc

SEQ ID NO: 1337 - DNA, 9 bp, Artificial Sequence
  Synthetic oligonucleotide
agcagcttc

SEQ ID NO: 1338 - DNA, 9 bp, Artificial Sequence
  Synthetic oligonucleotide
agcagcttc

SEQ ID NO: 1339 - DNA, 9 bp, Artificial Sequence
  Synthetic oligonucleotide
agcagcttc

SEQ ID NO: 1340 - DNA, 9 bp, Artificial Sequence
  Synthetic oligonucleotide
agcagcttc

SEQ ID NO: 1341 - DNA, 9 bp, Artificial Sequence
  Synthetic oligonucleotide
agcagagtc

SEQ ID NO: 1342 - DNA, 9 bp, Artificial Sequence
  Synthetic oligonucleotide
agcagcttc

SEQ ID NO: 1343 - DNA, 9 bp, Artificial Sequence
  Synthetic oligonucleotide
agcagcgta

SEQ ID NO: 1344 - DNA, 9 bp, Artificial Sequence
  Synthetic oligonucleotide
agcagtgtc

SEQ ID NO: 1345 - DNA, 9 bp, Artificial Sequence
  Synthetic oligonucleotide
agcagagtc

SEQ ID NO: 1346 - DNA, 9 bp, Artificial Sequence
  Synthetic oligonucleotide
agcagcgtg

SEQ ID NO: 1347 - DNA, 9 bp, Artificial Sequence
  Synthetic oligonucleotide
ggcagcgtc

SEQ ID NO: 1348 - DNA, 9 bp, Artificial Sequence
  Synthetic oligonucleotide
agcagcttc

SEQ ID NO: 1349 - DNA, 9 bp, Artificial Sequence
  Synthetic oligonucleotide
atcagcgtc

SEQ ID NO: 1350 - DNA, 9 bp, Artificial Sequence
  Synthetic oligonucleotide
agcagcggc

SEQ ID NO: 1351 - DNA, 9 bp, Artificial Sequence
  Synthetic oligonucleotide
agcagcttc

SEQ ID NO: 1352 - DNA, 9 bp, Artificial Sequence
  Synthetic oligonucleotide
agcagcttc

SEQ ID NO: 1353 - DNA, 9 bp, Artificial Sequence
  Synthetic oligonucleotide
agcagcatc

SEQ ID NO: 1354 - DNA, 9 bp, Artificial Sequence
  Synthetic oligonucleotide
agcagagtc

SEQ ID NO: 1355 - DNA, 9 bp, Artificial Sequence
  Synthetic oligonucleotide
agcagggtc

SEQ ID NO: 1356 - DNA, 9 bp, Artificial Sequence
  Synthetic oligonucleotide
agcagagtc

SEQ ID NO: 1357 - DNA, 9 bp, Artificial Sequence
  Synthetic oligonucleotide
agcagagtc

SEQ ID NO: 1358 - DNA, 9 bp, Artificial Sequence
  Synthetic oligonucleotide
tgcagcgtc

SEQ ID NO: 1359 - DNA, 9 bp, Artificial Sequence
  Synthetic oligonucleotide
agcatcgtc

SEQ ID NO: 1360 - DNA, 9 bp, Artificial Sequence
  Synthetic oligonucleotide
agcagtgtc

SEQ ID NO: 1361 - DNA, 9 bp, Artificial Sequence
  Synthetic oligonucleotide
agcagcttc

SEQ ID NO: 1362 - DNA, 9 bp, Artificial Sequence
  Synthetic oligonucleotide
agcagggtc

SEQ ID NO: 1363 - DNA, 9 bp, Artificial Sequence
  Synthetic oligonucleotide
agcagtgtc

SEQ ID NO: 1364 - DNA, 9 bp, Artificial Sequence
  Synthetic oligonucleotide
agcagggtc

SEQ ID NO: 1365 - DNA, 9 bp, Artificial Sequence
  Synthetic oligonucleotide
agcagcatc

SEQ ID NO: 1366 - DNA, 9 bp, Artificial Sequence
  Synthetic oligonucleotide
agcagtgtc

SEQ ID NO: 1367 - DNA, 9 bp, Artificial Sequence
  Synthetic oligonucleotide
agcagcttc

SEQ ID NO: 1368 - DNA, 9 bp, Artificial Sequence
  Synthetic oligonucleotide
agcagagtc

SEQ ID NO: 1369 - DNA, 9 bp, Artificial Sequence
  Synthetic oligonucleotide
agcagtgtc

SEQ ID NO: 1370 - DNA, 9 bp, Artificial Sequence
  Synthetic oligonucleotide
agcatcgtc

SEQ ID NO: 1371 - DNA, 9 bp, Artificial Sequence
  Synthetic oligonucleotide
agcagggtc

SEQ ID NO: 1372 - DNA, 9 bp, Artificial Sequence
  Synthetic oligonucleotide
agcagagtc

SEQ ID NO: 1373 - DNA, 9 bp, Artificial Sequence
  Synthetic oligonucleotide
agcagcggc

SEQ ID NO: 1374 - DNA, 9 bp, Artificial Sequence
  Synthetic oligonucleotide
agcagagtc

SEQ ID NO: 1375 - DNA, 9 bp, Artificial Sequence
  Synthetic oligonucleotide
agcagcggc

SEQ ID NO: 1376 - DNA, 9 bp, Artificial Sequence
  Synthetic oligonucleotide
agcagcggc

SEQ ID NO: 1377 - DNA, 9 bp, Artificial Sequence
  Synthetic oligonucleotide
agcagcggc

SEQ ID NO: 1378 - DNA, 9 bp, Artificial Sequence
  Synthetic oligonucleotide
agcagcggc

SEQ ID NO: 1379 - DNA, 9 bp, Artificial Sequence
  Synthetic oligonucleotide
agcagcggc

SEQ ID NO: 1380 - DNA, 9 bp, Artificial Sequence
  Synthetic oligonucleotide
agcagcggc

SEQ ID NO: 1381 - DNA, 9 bp, Artificial Sequence
  Synthetic oligonucleotide
agcagcggc

SEQ ID NO: 1382 - DNA, 9 bp, Artificial Sequence
  Synthetic oligonucleotide
agcagcggc

SEQ ID NO: 1383 - DNA, 9 bp, Artificial Sequence
  Synthetic oligonucleotide
agcagcggc

SEQ ID NO: 1384 - DNA, 9 bp, Artificial Sequence
  Synthetic oligonucleotide
tgcagcgtc

SEQ ID NO: 1385 - DNA, 9 bp, Artificial Sequence
  Synthetic oligonucleotide
agcagtgtc

SEQ ID NO: 1386 - DNA, 9 bp, Artificial Sequence
  Synthetic oligonucleotide
agcagcgta

SEQ ID NO: 1387 - DNA, 9 bp, Artificial Sequence
  Synthetic oligonucleotide
agcatcgtc

SEQ ID NO: 1388 - DNA, 9 bp, Artificial Sequence
  Synthetic oligonucleotide
agcagcggc

SEQ ID NO: 1389 - DNA, 9 bp, Artificial Sequence
  Synthetic oligonucleotide
agcagcgtt

SEQ ID NO: 1390 - DNA, 9 bp, Artificial Sequence
  Synthetic oligonucleotide
agcagagtc

SEQ ID NO: 1391 - DNA, 9 bp, Artificial Sequence
  Synthetic oligonucleotide
agcagtgtc

SEQ ID NO: 1392 - DNA, 9 bp, Artificial Sequence
  Synthetic oligonucleotide
agcagcatc

SEQ ID NO: 1393 - DNA, 9 bp, Artificial Sequence
  Synthetic oligonucleotide
agcaacgtc

SEQ ID NO: 1394 - DNA, 9 bp, Artificial Sequence
  Synthetic oligonucleotide
agcaccgtc

SEQ ID NO: 1395 - DNA, 9 bp, Artificial Sequence
  Synthetic oligonucleotide
agcagggtc

SEQ ID NO: 1396 - DNA, 9 bp, Artificial Sequence
  Synthetic oligonucleotide
ggcagcgtc

SEQ ID NO: 1397 - DNA, 9 bp, Artificial Sequence
  Synthetic oligonucleotide
agcatcgtc

SEQ ID NO: 1398 - DNA, 9 bp, Artificial Sequence
  Synthetic oligonucleotide
agcagtgtc

SEQ ID NO: 1399 - DNA, 9 bp, Artificial Sequence
  Synthetic oligonucleotide
agcagtgtc

SEQ ID NO: 1400 - DNA, 9 bp, Artificial Sequence
  Synthetic oligonucleotide
agcagcgtt

SEQ ID NO: 1401 - DNA, 9 bp, Artificial Sequence
  Synthetic oligonucleotide
agcagcggc

SEQ ID NO: 1402 - DNA, 9 bp, Artificial Sequence
  Synthetic oligonucleotide
agcaccgtc

SEQ ID NO: 1403 - DNA, 9 bp, Artificial Sequence
  Synthetic oligonucleotide
agcagtgtc

SEQ ID NO: 1404 - DNA, 9 bp, Artificial Sequence
  Synthetic oligonucleotide
agcagcgcc

SEQ ID NO: 1405 - DNA, 9 bp, Artificial Sequence
  Synthetic oligonucleotide
agcagagtc

SEQ ID NO: 1406 - DNA, 9 bp, Artificial Sequence
  Synthetic oligonucleotide
agcagcttc

SEQ ID NO: 1407 - DNA, 9 bp, Artificial Sequence
  Synthetic oligonucleotide
agcagcttc

SEQ ID NO: 1408 - DNA, 9 bp, Artificial Sequence
  Synthetic oligonucleotide
agcagcttc

SEQ ID NO: 1409 - DNA, 9 bp, Artificial Sequence
  Synthetic oligonucleotide
agcagcttc

SEQ ID NO: 1410 - DNA, 9 bp, Artificial Sequence
  Synthetic oligonucleotide
agcagcttc

SEQ ID NO: 1411 - DNA, 9 bp, Artificial Sequence
  Synthetic oligonucleotide
agcagcttc

SEQ ID NO: 1412 - DNA, 9 bp, Artificial Sequence
  Synthetic oligonucleotide
agcagcttc

SEQ ID NO: 1413 - DNA, 9 bp, Artificial Sequence
  Synthetic oligonucleotide
agcagcttc

SEQ ID NO: 1414 - DNA, 9 bp, Artificial Sequence
  Synthetic oligonucleotide
agcagcttc

SEQ ID NO: 1415 - DNA, 9 bp, Artificial Sequence
  Synthetic oligonucleotide
agcagcttc

SEQ ID NO: 1416 - DNA, 9 bp, Artificial Sequence
  Synthetic oligonucleotide
agcagcttc

SEQ ID NO: 1417 - DNA, 9 bp, Artificial Sequence
  Synthetic oligonucleotide
agcagcttc

SEQ ID NO: 1418 - DNA, 9 bp, Artificial Sequence
  Synthetic oligonucleotide
agcagcttc

SEQ ID NO: 1419 - DNA, 9 bp, Artificial Sequence
  Synthetic oligonucleotide
agcagcttc

SEQ ID NO: 1420 - DNA, 9 bp, Artificial Sequence
  Synthetic oligonucleotide
agcagagtc

SEQ ID NO: 1421 - DNA, 9 bp, Artificial Sequence
  Synthetic oligonucleotide
agcagggtc

SEQ ID NO: 1422 - DNA, 9 bp, Artificial Sequence
  Synthetic oligonucleotide
agcagggtc

SEQ ID NO: 1423 - DNA, 9 bp, Artificial Sequence
  Synthetic oligonucleotide
ggcagcgtc

SEQ ID NO: 1424 - DNA, 9 bp, Artificial Sequence
  Synthetic oligonucleotide
agcagcgtg

SEQ ID NO: 1425 - DNA, 9 bp, Artificial Sequence
  Synthetic oligonucleotide
agcaccgtc

SEQ ID NO: 1426 - DNA, 9 bp, Artificial Sequence
  Synthetic oligonucleotide
agcagcttc

SEQ ID NO: 1427 - DNA, 9 bp, Artificial Sequence
  Synthetic oligonucleotide
agcagcatc

SEQ ID NO: 1428 - DNA, 9 bp, Artificial Sequence
  Synthetic oligonucleotide
agcagcgtg

SEQ ID NO: 1429 - DNA, 9 bp, Artificial Sequence
  Synthetic oligonucleotide
agcagcggc

SEQ ID NO: 1430 - DNA, 9 bp, Artificial Sequence
  Synthetic oligonucleotide
agcagggtc

SEQ ID NO: 1431 - DNA, 9 bp, Artificial Sequence
  Synthetic oligonucleotide
agcagcggc

SEQ ID NO: 1432 - DNA, 9 bp, Artificial Sequence
  Synthetic oligonucleotide
agctgcgtc

SEQ ID NO: 1433 - DNA, 9 bp, Artificial Sequence
  Synthetic oligonucleotide
agcagggtc

SEQ ID NO: 1434 - DNA, 9 bp, Artificial Sequence
  Synthetic oligonucleotide
agcagcatc

SEQ ID NO: 1435 - DNA, 9 bp, Artificial Sequence
  Synthetic oligonucleotide
agcagtgtc

SEQ ID NO: 1436 - DNA, 9 bp, Artificial Sequence
  Synthetic oligonucleotide
agcagcgac

SEQ ID NO: 1437 - DNA, 9 bp, Artificial Sequence
  Synthetic oligonucleotide
agcagggtc

SEQ ID NO: 1438 - DNA, 9 bp, Artificial Sequence
  Synthetic oligonucleotide
agctgtgtc

SEQ ID NO: 1439 - DNA, 9 bp, Artificial Sequence
  Synthetic oligonucleotide
agctgggtc

SEQ ID NO: 1440 - DNA, 9 bp, Artificial Sequence
  Synthetic oligonucleotide
agctgggtc

SEQ ID NO: 1441 - DNA, 9 bp, Artificial Sequence
  Synthetic oligonucleotide
ggcagcggc

SEQ ID NO: 1442 - DNA, 9 bp, Artificial Sequence
  Synthetic oligonucleotide
agcatggtc

SEQ ID NO: 1443 - DNA, 9 bp, Artificial Sequence
  Synthetic oligonucleotide
atcagcctc

SEQ ID NO: 1444 - DNA, 9 bp, Artificial Sequence
  Synthetic oligonucleotide
agcatggtc

SEQ ID NO: 1445 - DNA, 9 bp, Artificial Sequence
  Synthetic oligonucleotide
agcaggggc

SEQ ID NO: 1446 - DNA, 9 bp, Artificial Sequence
  Synthetic oligonucleotide
aacagcgtg

SEQ ID NO: 1447 - DNA, 9 bp, Artificial Sequence
  Synthetic oligonucleotide
aacagagtc

SEQ ID NO: 1448 - DNA, 9 bp, Artificial Sequence
  Synthetic oligonucleotide
aacagcatc

SEQ ID NO: 1449 - DNA, 9 bp, Artificial Sequence
  Synthetic oligonucleotide
atcagtgtc

SEQ ID NO: 1450 - DNA, 9 bp, Artificial Sequence
  Synthetic oligonucleotide
agcagctgc

SEQ ID NO: 1451 - DNA, 9 bp, Artificial Sequence
  Synthetic oligonucleotide
agcagggtt

SEQ ID NO: 1452 - DNA, 9 bp, Artificial Sequence
  Synthetic oligonucleotide
agcatagtc

SEQ ID NO: 1453 - DNA, 9 bp, Artificial Sequence
  Synthetic oligonucleotide
agcagcaac

SEQ ID NO: 1454 - DNA, 9 bp, Artificial Sequence
  Synthetic oligonucleotide
agctacgtc

SEQ ID NO: 1455 - DNA, 9 bp, Artificial Sequence
  Synthetic oligonucleotide
agcagcatt

SEQ ID NO: 1456 - DNA, 9 bp, Artificial Sequence
  Synthetic oligonucleotide
agcattgtc

SEQ ID NO: 1457 - DNA, 9 bp, Artificial Sequence
  Synthetic oligonucleotide
agcagcacc

SEQ ID NO: 1458 - DNA, 9 bp, Artificial Sequence
  Synthetic oligonucleotide
agcagggtt

SEQ ID NO: 1459 - DNA, 9 bp, Artificial Sequence
  Synthetic oligonucleotide
agtagagtc

SEQ ID NO: 1460 - DNA, 9 bp, Artificial Sequence
  Synthetic oligonucleotide
agcaacgtg

SEQ ID NO: 1461 - DNA, 9 bp, Artificial Sequence
  Synthetic oligonucleotide
agcaaggtc

SEQ ID NO: 1462 - DNA, 9 bp, Artificial Sequence
  Synthetic oligonucleotide
agcagccac

SEQ ID NO: 1463 - DNA, 9 bp, Artificial Sequence
  Synthetic oligonucleotide
agcaatgtc

SEQ ID NO: 1464 - DNA, 9 bp, Artificial Sequence
  Synthetic oligonucleotide
agcagctac

SEQ ID NO: 1465 - DNA, 9 bp, Artificial Sequence
  Synthetic oligonucleotide
agcagctgc

SEQ ID NO: 1466 - DNA, 9 bp, Artificial Sequence
  Synthetic oligonucleotide
agcaggggc

SEQ ID NO: 1467 - DNA, 9 bp, Artificial Sequence
  Synthetic oligonucleotide
agcaacgtg

SEQ ID NO: 1468 - DNA, 9 bp, Artificial Sequence
  Synthetic oligonucleotide
aacagcgta

SEQ ID NO: 1469 - DNA, 9 bp, Artificial Sequence
  Synthetic oligonucleotide
tgcaccgtc

SEQ ID NO: 1470 - DNA, 9 bp, Artificial Sequence
  Synthetic oligonucleotide
agcagtgtg

SEQ ID NO: 1471 - DNA, 9 bp, Artificial Sequence
  Synthetic oligonucleotide
agcagctgc

SEQ ID NO: 1472 - DNA, 9 bp, Artificial Sequence
  Synthetic oligonucleotide
agcaccttc

SEQ ID NO: 1473 - DNA, 9 bp, Artificial Sequence
  Synthetic oligonucleotide
agcaaggtc

SEQ ID NO: 1474 - DNA, 9 bp, Artificial Sequence
  Synthetic oligonucleotide
agctgcgtg

SEQ ID NO: 1475 - DNA, 9 bp, Artificial Sequence
  Synthetic oligonucleotide
agcaaggtc

SEQ ID NO: 1476 - DNA, 9 bp, Artificial Sequence
  Synthetic oligonucleotide
agcagattc

SEQ ID NO: 1477 - DNA, 9 bp, Artificial Sequence
  Synthetic oligonucleotide
agcaaagtc

SEQ ID NO: 1478 - DNA, 9 bp, Artificial Sequence
  Synthetic oligonucleotide
tgcagggtc

SEQ ID NO: 1479 - DNA, 9 bp, Artificial Sequence
  Synthetic oligonucleotide
agcagaatc

SEQ ID NO: 1480 - DNA, 9 bp, Artificial Sequence
  Synthetic oligonucleotide
agctgagtc

SEQ ID NO: 1481 - DNA, 9 bp, Artificial Sequence
  Synthetic oligonucleotide
agcattgtc

SEQ ID NO: 1482 - DNA, 9 bp, Artificial Sequence
  Synthetic oligonucleotide
tgcagggtc

SEQ ID NO: 1483 - DNA, 9 bp, Artificial Sequence
  Synthetic oligonucleotide
agcaacttc

SEQ ID NO: 1484 - DNA, 9 bp, Artificial Sequence
  Synthetic oligonucleotide
agcagctgc

SEQ ID NO: 1485 - DNA, 9 bp, Artificial Sequence
  Synthetic oligonucleotide
agcagggtt

SEQ ID NO: 1486 - DNA, 9 bp, Artificial Sequence
  Synthetic oligonucleotide
agcaaggtc

SEQ ID NO: 1487 - DNA, 9 bp, Artificial Sequence
  Synthetic oligonucleotide
agctgtgtc

SEQ ID NO: 1488 - DNA, 9 bp, Artificial Sequence
  Synthetic oligonucleotide
aacagcatc

SEQ ID NO: 1489 - DNA, 9 bp, Artificial Sequence
  Synthetic oligonucleotide
agaagcttc

SEQ ID NO: 1490 - DNA, 9 bp, Artificial Sequence
  Synthetic oligonucleotide
agcagagtt

SEQ ID NO: 1491 - DNA, 9 bp, Artificial Sequence
  Synthetic oligonucleotide
agcagagtt

SEQ ID NO: 1492 - DNA, 9 bp, Artificial Sequence
  Synthetic oligonucleotide
aggagggtc

SEQ ID NO: 1493 - DNA, 9 bp, Artificial Sequence
  Synthetic oligonucleotide
agcaacttc

SEQ ID NO: 1494 - DNA, 9 bp, Artificial Sequence
  Synthetic oligonucleotide
agcagctcc

SEQ ID NO: 1495 - DNA, 9 bp, Artificial Sequence
  Synthetic oligonucleotide
agcaaagtc

SEQ ID NO: 1496 - DNA, 9 bp, Artificial Sequence
  Synthetic oligonucleotide
agcaacgtg

SEQ ID NO: 1497 - DNA, 9 bp, Artificial Sequence
  Synthetic oligonucleotide
agcagggtg

SEQ ID NO: 1498 - DNA, 9 bp, Artificial Sequence
  Synthetic oligonucleotide
agcaggttc

SEQ ID NO: 1499 - DNA, 9 bp, Artificial Sequence
  Synthetic oligonucleotide
agcagcttg

SEQ ID NO: 1500 - DNA, 9 bp, Artificial Sequence
  Synthetic oligonucleotide
agcagtgtt

SEQ ID NO: 1501 - DNA, 9 bp, Artificial Sequence
  Synthetic oligonucleotide
agaggcgtc

SEQ ID NO: 1502 - DNA, 9 bp, Artificial Sequence
  Synthetic oligonucleotide
agcagtgac

SEQ ID NO: 1503 - DNA, 9 bp, Artificial Sequence
  Synthetic oligonucleotide
agcaccttc

SEQ ID NO: 1504 - DNA, 9 bp, Artificial Sequence
  Synthetic oligonucleotide
atcagtgtc

SEQ ID NO: 1505 - DNA, 9 bp, Artificial Sequence
  Synthetic oligonucleotide
agcagcagc

SEQ ID NO: 1506 - DNA, 9 bp, Artificial Sequence
  Synthetic oligonucleotide
agcagtgac

SEQ ID NO: 1507 - DNA, 9 bp, Artificial Sequence
  Synthetic oligonucleotide
agcagggtt

SEQ ID NO: 1508 - DNA, 9 bp, Artificial Sequence
  Synthetic oligonucleotide
agctgcggc

SEQ ID NO: 1509 - DNA, 9 bp, Artificial Sequence
  Synthetic oligonucleotide
agcaacatc

SEQ ID NO: 1510 - DNA, 9 bp, Artificial Sequence
  Synthetic oligonucleotide
agcaacgta

SEQ ID NO: 1511 - DNA, 9 bp, Artificial Sequence
  Synthetic oligonucleotide
agcaggatc

SEQ ID NO: 1512 - DNA, 9 bp, Artificial Sequence
  Synthetic oligonucleotide
agcagcaac

SEQ ID NO: 1513 - DNA, 9 bp, Artificial Sequence
  Synthetic oligonucleotide
agtagcggc

SEQ ID NO: 1514 - DNA, 9 bp, Artificial Sequence
  Synthetic oligonucleotide
agcagcccc

SEQ ID NO: 1515 - DNA, 9 bp, Artificial Sequence
  Synthetic oligonucleotide
agcagctgc

SEQ ID NO: 1516 - DNA, 9 bp, Artificial Sequence
  Synthetic oligonucleotide
agcaccgtt

SEQ ID NO: 1517 - DNA, 9 bp, Artificial Sequence
  Synthetic oligonucleotide
agcagggtg

SEQ ID NO: 1518 - DNA, 9 bp, Artificial Sequence
  Synthetic oligonucleotide
agctgggtc

SEQ ID NO: 1519 - DNA, 9 bp, Artificial Sequence
  Synthetic oligonucleotide
accaccgtc

SEQ ID NO: 1520 - DNA, 9 bp, Artificial Sequence
  Synthetic oligonucleotide
agaagcttc

SEQ ID NO: 1521 - DNA, 9 bp, Artificial Sequence
  Synthetic oligonucleotide
agcagaggc

SEQ ID NO: 1522 - DNA, 9 bp, Artificial Sequence
  Synthetic oligonucleotide
agcatcgtt

SEQ ID NO: 1523 - DNA, 9 bp, Artificial Sequence
  Synthetic oligonucleotide
agaagcgtg

SEQ ID NO: 1524 - DNA, 9 bp, Artificial Sequence
  Synthetic oligonucleotide
gacagcgtc

SEQ ID NO: 1525 - DNA, 9 bp, Artificial Sequence
  Synthetic oligonucleotide
agcagagac

SEQ ID NO: 1526 - DNA, 9 bp, Artificial Sequence
  Synthetic oligonucleotide
agcaaagtc

SEQ ID NO: 1527 - DNA, 9 bp, Artificial Sequence
  Synthetic oligonucleotide
agcattgtc

SEQ ID NO: 1528 - DNA, 9 bp, Artificial Sequence
  Synthetic oligonucleotide
agcaaagtc

SEQ ID NO: 1529 - DNA, 9 bp, Artificial Sequence
  Synthetic oligonucleotide
agcacagtc

SEQ ID NO: 1530 - DNA, 9 bp, Artificial Sequence
  Synthetic oligonucleotide
agcagcagc

SEQ ID NO: 1531 - DNA, 9 bp, Artificial Sequence
  Synthetic oligonucleotide
agcagggtg

SEQ ID NO: 1532 - DNA, 9 bp, Artificial Sequence
  Synthetic oligonucleotide
aggagcatc

SEQ ID NO: 1533 - DNA, 9 bp, Artificial Sequence
  Synthetic oligonucleotide
agctgggtc

SEQ ID NO: 1534 - DNA, 9 bp, Artificial Sequence
  Synthetic oligonucleotide
agctgtgtc

SEQ ID NO: 1535 - DNA, 9 bp, Artificial Sequence
  Synthetic oligonucleotide
agctgtgtc

SEQ ID NO: 1536 - DNA, 9 bp, Artificial Sequence
  Synthetic oligonucleotide
aggagcgta

SEQ ID NO: 1537 - DNA, 9 bp, Artificial Sequence
  Synthetic oligonucleotide
agcagccac

SEQ ID NO: 1538 - DNA, 9 bp, Artificial Sequence
  Synthetic oligonucleotide
agcagcatg

SEQ ID NO: 1539 - DNA, 9 bp, Artificial Sequence
  Synthetic oligonucleotide
agcattgtc

SEQ ID NO: 1540 - DNA, 9 bp, Artificial Sequence
  Synthetic oligonucleotide
agcagcctg

SEQ ID NO: 1541 - DNA, 9 bp, Artificial Sequence
  Synthetic oligonucleotide
agcagctcc

SEQ ID NO: 1542 - DNA, 9 bp, Artificial Sequence
  Synthetic oligonucleotide
agcagcagc

SEQ ID NO: 1543 - DNA, 9 bp, Artificial Sequence
  Synthetic oligonucleotide
agcaacttc

SEQ ID NO: 1544 - DNA, 9 bp, Artificial Sequence
  Synthetic oligonucleotide
agcagagta

SEQ ID NO: 1545 - DNA, 9 bp, Artificial Sequence
  Synthetic oligonucleotide
agcagcctt

SEQ ID NO: 1546 - DNA, 9 bp, Artificial Sequence
  Synthetic oligonucleotide
agcagtgtt

SEQ ID NO: 1547 - DNA, 9 bp, Artificial Sequence
  Synthetic oligonucleotide
agaagcatc

SEQ ID NO: 1548 - DNA, 9 bp, Artificial Sequence
  Synthetic oligonucleotide
agcagggta

SEQ ID NO: 1549 - DNA, 9 bp, Artificial Sequence
  Synthetic oligonucleotide
agcagagtt

SEQ ID NO: 1550 - DNA, 9 bp, Artificial Sequence
  Synthetic oligonucleotide
agcagaggc

SEQ ID NO: 1551 - DNA, 9 bp, Artificial Sequence
  Synthetic oligonucleotide
agcaacatc

SEQ ID NO: 1552 - DNA, 9 bp, Artificial Sequence
  Synthetic oligonucleotide
agcagagta

SEQ ID NO: 1553 - DNA, 9 bp, Artificial Sequence
  Synthetic oligonucleotide
agcatcgtt

SEQ ID NO: 1554 - DNA, 9 bp, Artificial Sequence
  Synthetic oligonucleotide
agaagcttc

SEQ ID NO: 1555 - DNA, 9 bp, Artificial Sequence
  Synthetic oligonucleotide
atcagcggc

SEQ ID NO: 1556 - DNA, 9 bp, Artificial Sequence
  Synthetic oligonucleotide
agcagaatc

SEQ ID NO: 1557 - DNA, 9 bp, Artificial Sequence
  Synthetic oligonucleotide
agctacgtc

SEQ ID NO: 1558 - DNA, 9 bp, Artificial Sequence
  Synthetic oligonucleotide
agcaatgtc

SEQ ID NO: 1559 - DNA, 9 bp, Artificial Sequence
  Synthetic oligonucleotide
agcattgtc

SEQ ID NO: 1560 - DNA, 9 bp, Artificial Sequence
  Synthetic oligonucleotide
agcaccgcc

SEQ ID NO: 1561 - DNA, 9 bp, Artificial Sequence
  Synthetic oligonucleotide
agcacggtc

SEQ ID NO: 1562 - DNA, 9 bp, Artificial Sequence
  Synthetic oligonucleotide
agcaacatc

SEQ ID NO: 1563 - DNA, 9 bp, Artificial Sequence
  Synthetic oligonucleotide
agcagggtt

SEQ ID NO: 1564 - DNA, 9 bp, Artificial Sequence
  Synthetic oligonucleotide
agcagctgc

SEQ ID NO: 1565 - DNA, 9 bp, Artificial Sequence
  Synthetic oligonucleotide
agcagtgtg

SEQ ID NO: 1566 - DNA, 9 bp, Artificial Sequence
  Synthetic oligonucleotide
aacagagtc

SEQ ID NO: 1567 - DNA, 9 bp, Artificial Sequence
  Synthetic oligonucleotide
ggcagtgtc

SEQ ID NO: 1568 - DNA, 9 bp, Artificial Sequence
  Synthetic oligonucleotide
agcagtgtg

SEQ ID NO: 1569 - DNA, 9 bp, Artificial Sequence
  Synthetic oligonucleotide
agcaaggtc

SEQ ID NO: 1570 - DNA, 9 bp, Artificial Sequence
  Synthetic oligonucleotide
agcagtgtg

SEQ ID NO: 1571 - DNA, 9 bp, Artificial Sequence
  Synthetic oligonucleotide
agcagtgtg

SEQ ID NO: 1572 - DNA, 9 bp, Artificial Sequence
  Synthetic oligonucleotide
agcagtgtg

SEQ ID NO: 1573 - DNA, 9 bp, Artificial Sequence
  Synthetic oligonucleotide
agcagtgtg

SEQ ID NO: 1574 - DNA, 9 bp, Artificial Sequence
  Synthetic oligonucleotide
agcagtgtg

SEQ ID NO: 1575 - DNA, 9 bp, Artificial Sequence
  Synthetic oligonucleotide
agcagcatg

SEQ ID NO: 1576 - DNA, 9 bp, Artificial Sequence
  Synthetic oligonucleotide
agcactgtc

SEQ ID NO: 1577 - DNA, 9 bp, Artificial Sequence
  Synthetic oligonucleotide
ggcagtgtc

SEQ ID NO: 1578 - DNA, 9 bp, Artificial Sequence
  Synthetic oligonucleotide
cacagcgtc

SEQ ID NO: 1579 - DNA, 9 bp, Artificial Sequence
  Synthetic oligonucleotide
agcaccttc

SEQ ID NO: 1580 - DNA, 9 bp, Artificial Sequence
  Synthetic oligonucleotide
agcacagtc

SEQ ID NO: 1581 - DNA, 9 bp, Artificial Sequence
  Synthetic oligonucleotide
agcagattc

SEQ ID NO: 1582 - DNA, 9 bp, Artificial Sequence
  Synthetic oligonucleotide
aggagggtc

SEQ ID NO: 1583 - DNA, 9 bp, Artificial Sequence
  Synthetic oligonucleotide
agcaacgtg

SEQ ID NO: 1584 - DNA, 9 bp, Artificial Sequence
  Synthetic oligonucleotide
agcggcgtt

SEQ ID NO: 1585 - DNA, 9 bp, Artificial Sequence
  Synthetic oligonucleotide
aggagtgtc

SEQ ID NO: 1586 - DNA, 9 bp, Artificial Sequence
  Synthetic oligonucleotide
agctgcttc

SEQ ID NO: 1587 - DNA, 9 bp, Artificial Sequence
  Synthetic oligonucleotide
agcaacatc

SEQ ID NO: 1588 - DNA, 9 bp, Artificial Sequence
  Synthetic oligonucleotide
agcatagtc

SEQ ID NO: 1589 - DNA, 9 bp, Artificial Sequence
  Synthetic oligonucleotide
agcaacatc

SEQ ID NO: 1590 - DNA, 9 bp, Artificial Sequence
  Synthetic oligonucleotide
ggcagcgcc

SEQ ID NO: 1591 - DNA, 9 bp, Artificial Sequence
  Synthetic oligonucleotide
agcagagtg

SEQ ID NO: 1592 - DNA, 9 bp, Artificial Sequence
  Synthetic oligonucleotide
agcaaagtc

SEQ ID NO: 1593 - DNA, 9 bp, Artificial Sequence
  Synthetic oligonucleotide
gacagcgtc

SEQ ID NO: 1594 - DNA, 9 bp, Artificial Sequence
  Synthetic oligonucleotide
agcggcggc

SEQ ID NO: 1595 - DNA, 9 bp, Artificial Sequence
  Synthetic oligonucleotide
agccgcatc

SEQ ID NO: 1596 - DNA, 9 bp, Artificial Sequence
  Synthetic oligonucleotide
agcaaagtc

SEQ ID NO: 1597 - DNA, 9 bp, Artificial Sequence
  Synthetic oligonucleotide
agcaggttc

SEQ ID NO: 1598 - DNA, 9 bp, Artificial Sequence
  Synthetic oligonucleotide
agctgggtc

SEQ ID NO: 1599 - DNA, 9 bp, Artificial Sequence
  Synthetic oligonucleotide
agcagagac

SEQ ID NO: 1600 - DNA, 9 bp, Artificial Sequence
  Synthetic oligonucleotide
agcagaggc

SEQ ID NO: 1601 - DNA, 9 bp, Artificial Sequence
  Synthetic oligonucleotide
agctgagtc

SEQ ID NO: 1602 - DNA, 9 bp, Artificial Sequence
  Synthetic oligonucleotide
agtagagtc

SEQ ID NO: 1603 - DNA, 9 bp, Artificial Sequence
  Synthetic oligonucleotide
tgcagcgac

SEQ ID NO: 1604 - DNA, 9 bp, Artificial Sequence
  Synthetic oligonucleotide
agcagctgc

SEQ ID NO: 1605 - DNA, 9 bp, Artificial Sequence
  Synthetic oligonucleotide
agcagcatg

SEQ ID NO: 1606 - DNA, 9 bp, Artificial Sequence
  Synthetic oligonucleotide
agctgagtc

SEQ ID NO: 1607 - DNA, 9 bp, Artificial Sequence
  Synthetic oligonucleotide
agcaacatc

SEQ ID NO: 1608 - DNA, 9 bp, Artificial Sequence
  Synthetic oligonucleotide
agcaacatc

SEQ ID NO: 1609 - DNA, 9 bp, Artificial Sequence
  Synthetic oligonucleotide
accagcttc

SEQ ID NO: 1610 - DNA, 9 bp, Artificial Sequence
  Synthetic oligonucleotide
agcagcatt

SEQ ID NO: 1611 - DNA, 9 bp, Artificial Sequence
  Synthetic oligonucleotide
aggagtgtc

SEQ ID NO: 1612 - DNA, 9 bp, Artificial Sequence
  Synthetic oligonucleotide
agaagcggc

SEQ ID NO: 1613 - DNA, 9 bp, Artificial Sequence
  Synthetic oligonucleotide
agcagccac

SEQ ID NO: 1614 - DNA, 9 bp, Artificial Sequence
  Synthetic oligonucleotide
agcagcagc

SEQ ID NO: 1615 - DNA, 9 bp, Artificial Sequence
  Synthetic oligonucleotide
agcacagtc

SEQ ID NO: 1616 - DNA, 9 bp, Artificial Sequence
  Synthetic oligonucleotide
agctgcggc

SEQ ID NO: 1617 - DNA, 9 bp, Artificial Sequence
  Synthetic oligonucleotide
agcaaggtc

SEQ ID NO: 1618 - DNA, 9 bp, Artificial Sequence
  Synthetic oligonucleotide
agcaccttc

SEQ ID NO: 1619 - DNA, 9 bp, Artificial Sequence
  Synthetic oligonucleotide
agcagcatg

SEQ ID NO: 1620 - DNA, 9 bp, Artificial Sequence
  Synthetic oligonucleotide
agcaaggtc

SEQ ID NO: 1621 - DNA, 9 bp, Artificial Sequence
  Synthetic oligonucleotide
agcatggtc

SEQ ID NO: 1622 - DNA, 9 bp, Artificial Sequence
  Synthetic oligonucleotide
agcagcatg

SEQ ID NO: 1623 - DNA, 9 bp, Artificial Sequence
  Synthetic oligonucleotide
agcagggtg

SEQ ID NO: 1624 - DNA, 9 bp, Artificial Sequence
  Synthetic oligonucleotide
agaggtgtc

SEQ ID NO: 1625 - DNA, 9 bp, Artificial Sequence
  Synthetic oligonucleotide
gtcagggtc

SEQ ID NO: 1626 - DNA, 9 bp, Artificial Sequence
  Synthetic oligonucleotide
tgcactgtc

SEQ ID NO: 1627 - DNA, 9 bp, Artificial Sequence
  Synthetic oligonucleotide
tgcggagtc

SEQ ID NO: 1628 - DNA, 9 bp, Artificial Sequence
  Synthetic oligonucleotide
agaaacgtt

SEQ ID NO: 1629 - DNA, 9 bp, Artificial Sequence
  Synthetic oligonucleotide
aggagcaac

SEQ ID NO: 1630 - DNA, 9 bp, Artificial Sequence
  Synthetic oligonucleotide
cgctgtgtc

SEQ ID NO: 1631 - DNA, 9 bp, Artificial Sequence
  Synthetic oligonucleotide
agcgtggtc

SEQ ID NO: 1632 - DNA, 9 bp, Artificial Sequence
  Synthetic oligonucleotide
agcaggtcc

SEQ ID NO: 1633 - DNA, 9 bp, Artificial Sequence
  Synthetic oligonucleotide
ggctgtgtc

SEQ ID NO: 1634 - DNA, 9 bp, Artificial Sequence
  Synthetic oligonucleotide
tgcagagtt

SEQ ID NO: 1635 - DNA, 9 bp, Artificial Sequence
  Synthetic oligonucleotide
atcatggtc

SEQ ID NO: 1636 - DNA, 9 bp, Artificial Sequence
  Synthetic oligonucleotide
agcaacgcg

SEQ ID NO: 1637 - DNA, 9 bp, Artificial Sequence
  Synthetic oligonucleotide
tgaagtgtc

SEQ ID NO: 1638 - DNA, 9 bp, Artificial Sequence
  Synthetic oligonucleotide
agcaactcc

SEQ ID NO: 1639 - DNA, 9 bp, Artificial Sequence
  Synthetic oligonucleotide
agaaatgtc

SEQ ID NO: 1640 - DNA, 9 bp, Artificial Sequence
  Synthetic oligonucleotide
ggcagggta

SEQ ID NO: 1641 - DNA, 9 bp, Artificial Sequence
  Synthetic oligonucleotide
agcaacatg

SEQ ID NO: 1642 - DNA, 9 bp, Artificial Sequence
  Synthetic oligonucleotide
gacagcgtg

SEQ ID NO: 1643 - DNA, 9 bp, Artificial Sequence
  Synthetic oligonucleotide
ggctgagtc

SEQ ID NO: 1644 - DNA, 9 bp, Artificial Sequence
  Synthetic oligonucleotide
tgcagagtt

SEQ ID NO: 1645 - DNA, 9 bp, Artificial Sequence
  Synthetic oligonucleotide
agctgagtg

SEQ ID NO: 1646 - DNA, 9 bp, Artificial Sequence
  Synthetic oligonucleotide
aactgagtc

SEQ ID NO: 1647 - DNA, 9 bp, Artificial Sequence
  Synthetic oligonucleotide
aacatagtc

SEQ ID NO: 1648 - DNA, 9 bp, Artificial Sequence
  Synthetic oligonucleotide
agctgggtg

SEQ ID NO: 1649 - DNA, 9 bp, Artificial Sequence
  Synthetic oligonucleotide
agcaccata

SEQ ID NO: 1650 - DNA, 9 bp, Artificial Sequence
  Synthetic oligonucleotide
atcaggttc

SEQ ID NO: 1651 - DNA, 9 bp, Artificial Sequence
  Synthetic oligonucleotide
accacggtc

SEQ ID NO: 1652 - DNA, 9 bp, Artificial Sequence
  Synthetic oligonucleotide
accacggtc

SEQ ID NO: 1653 - DNA, 9 bp, Artificial Sequence
  Synthetic oligonucleotide
accacggtc

SEQ ID NO: 1654 - DNA, 9 bp, Artificial Sequence
  Synthetic oligonucleotide
accacggtc

SEQ ID NO: 1655 - DNA, 9 bp, Artificial Sequence
  Synthetic oligonucleotide
accatggtc

SEQ ID NO: 1656 - DNA, 9 bp, Artificial Sequence
  Synthetic oligonucleotide
agaaacttc

SEQ ID NO: 1657 - DNA, 9 bp, Artificial Sequence
  Synthetic oligonucleotide
cacagcttc

SEQ ID NO: 1658 - DNA, 9 bp, Artificial Sequence
  Synthetic oligonucleotide
atcatggtc

SEQ ID NO: 1659 - DNA, 9 bp, Artificial Sequence
  Synthetic oligonucleotide
agcagtgat

SEQ ID NO: 1660 - DNA, 9 bp, Artificial Sequence
  Synthetic oligonucleotide
accaaggtc

SEQ ID NO: 1661 - DNA, 9 bp, Artificial Sequence
  Synthetic oligonucleotide
agccccttc

SEQ ID NO: 1662 - DNA, 9 bp, Artificial Sequence
  Synthetic oligonucleotide
ctcagtgtc

SEQ ID NO: 1663 - DNA, 9 bp, Artificial Sequence
  Synthetic oligonucleotide
agttgcttc

SEQ ID NO: 1664 - DNA, 9 bp, Artificial Sequence
  Synthetic oligonucleotide
aagagagtc

SEQ ID NO: 1665 - DNA, 9 bp, Artificial Sequence
  Synthetic oligonucleotide
ggcagtgtg

SEQ ID NO: 1666 - DNA, 9 bp, Artificial Sequence
  Synthetic oligonucleotide
tgcagagtt

SEQ ID NO: 1667 - DNA, 9 bp, Artificial Sequence
  Synthetic oligonucleotide
agcctcgtt

SEQ ID NO: 1668 - DNA, 9 bp, Artificial Sequence
  Synthetic oligonucleotide
atcatcttc

SEQ ID NO: 1669 - DNA, 9 bp, Artificial Sequence
  Synthetic oligonucleotide
agtagtgtg

SEQ ID NO: 1670 - DNA, 9 bp, Artificial Sequence
  Synthetic oligonucleotide
agcctcgtg

SEQ ID NO: 1671 - DNA, 9 bp, Artificial Sequence
  Synthetic oligonucleotide
aaaagcgtt

SEQ ID NO: 1672 - DNA, 9 bp, Artificial Sequence
  Synthetic oligonucleotide
actagagtc

SEQ ID NO: 1673 - DNA, 9 bp, Artificial Sequence
  Synthetic oligonucleotide
ggcggcggc

SEQ ID NO: 1674 - DNA, 9 bp, Artificial Sequence
  Synthetic oligonucleotide
atgagagtc

SEQ ID NO: 1675 - DNA, 9 bp, Artificial Sequence
  Synthetic oligonucleotide
agcacagtg

SEQ ID NO: 1676 - DNA, 9 bp, Artificial Sequence
  Synthetic oligonucleotide
tacagggtc

SEQ ID NO: 1677 - DNA, 9 bp, Artificial Sequence
  Synthetic oligonucleotide
agcagaggt

SEQ ID NO: 1678 - DNA, 9 bp, Artificial Sequence
  Synthetic oligonucleotide
ggaagagtc

SEQ ID NO: 1679 - DNA, 9 bp, Artificial Sequence
  Synthetic oligonucleotide
ggaagagtc

SEQ ID NO: 1680 - DNA, 9 bp, Artificial Sequence
  Synthetic oligonucleotide
agtggggtc

SEQ ID NO: 1681 - DNA, 9 bp, Artificial Sequence
  Synthetic oligonucleotide
atgagggtc

SEQ ID NO: 1682 - DNA, 9 bp, Artificial Sequence
  Synthetic oligonucleotide
gtcagagtc

SEQ ID NO: 1683 - DNA, 9 bp, Artificial Sequence
  Synthetic oligonucleotide
gccagggtc

SEQ ID NO: 1684 - DNA, 9 bp, Artificial Sequence
  Synthetic oligonucleotide
agcaactcc

SEQ ID NO: 1685 - DNA, 9 bp, Artificial Sequence
  Synthetic oligonucleotide
aggggagtc

SEQ ID NO: 1686 - DNA, 9 bp, Artificial Sequence
  Synthetic oligonucleotide
gtcagggtc

SEQ ID NO: 1687 - DNA, 9 bp, Artificial Sequence
  Synthetic oligonucleotide
gtcagggtc

SEQ ID NO: 1688 - DNA, 9 bp, Artificial Sequence
  Synthetic oligonucleotide
agcatagta

SEQ ID NO: 1689 - DNA, 9 bp, Artificial Sequence
  Synthetic oligonucleotide
gtcagagtc

SEQ ID NO: 1690 - DNA, 9 bp, Artificial Sequence
  Synthetic oligonucleotide
ggcagtgtt

SEQ ID NO: 1691 - DNA, 9 bp, Artificial Sequence
  Synthetic oligonucleotide
gccatcgtc

SEQ ID NO: 1692 - DNA, 9 bp, Artificial Sequence
  Synthetic oligonucleotide
ctcagtgtc

SEQ ID NO: 1693 - DNA, 9 bp, Artificial Sequence
  Synthetic oligonucleotide
ggaagagtc

SEQ ID NO: 1694 - DNA, 9 bp, Artificial Sequence
  Synthetic oligonucleotide
agcaactcc

SEQ ID NO: 1695 - DNA, 9 bp, Artificial Sequence
  Synthetic oligonucleotide
agcctcggc

SEQ ID NO: 1696 - DNA, 9 bp, Artificial Sequence
  Synthetic oligonucleotide
gacagggtc

SEQ ID NO: 1697 - DNA, 9 bp, Artificial Sequence
  Synthetic oligonucleotide
agaatagtc

SEQ ID NO: 1698 - DNA, 9 bp, Artificial Sequence
  Synthetic oligonucleotide
agtagagta

SEQ ID NO: 1699 - DNA, 9 bp, Artificial Sequence
  Synthetic oligonucleotide
gggagggtc

SEQ ID NO: 1700 - DNA, 9 bp, Artificial Sequence
  Synthetic oligonucleotide
aacagggtt

SEQ ID NO: 1701 - DNA, 9 bp, Artificial Sequence
  Synthetic oligonucleotide
gccagggtc

SEQ ID NO: 1702 - DNA, 9 bp, Artificial Sequence
  Synthetic oligonucleotide
ggaagagtc

SEQ ID NO: 1703 - DNA, 9 bp, Artificial Sequence
  Synthetic oligonucleotide
agtggagtc

SEQ ID NO: 1704 - DNA, 9 bp, Artificial Sequence
  Synthetic oligonucleotide
gccagagtc

SEQ ID NO: 1705 - DNA, 9 bp, Artificial Sequence
  Synthetic oligonucleotide
ggcagtgta

SEQ ID NO: 1706 - DNA, 9 bp, Artificial Sequence
  Synthetic oligonucleotide
ctcagtgtc

SEQ ID NO: 1707 - DNA, 9 bp, Artificial Sequence
  Synthetic oligonucleotide
agatgggtc

SEQ ID NO: 1708 - DNA, 9 bp, Artificial Sequence
  Synthetic oligonucleotide
gccagagtc

SEQ ID NO: 1709 - DNA, 9 bp, Artificial Sequence
  Synthetic oligonucleotide
agtagggtt

SEQ ID NO: 1710 - DNA, 9 bp, Artificial Sequence
  Synthetic oligonucleotide
cactgcgtc

SEQ ID NO: 1711 - DNA, 9 bp, Artificial Sequence
  Synthetic oligonucleotide
aactgggtc

SEQ ID NO: 1712 - DNA, 9 bp, Artificial Sequence
  Synthetic oligonucleotide
agtaacatc

SEQ ID NO: 1713 - DNA, 9 bp, Artificial Sequence
  Synthetic oligonucleotide
gacagagtc

SEQ ID NO: 1714 - DNA, 9 bp, Artificial Sequence
  Synthetic oligonucleotide
atcaggttc

SEQ ID NO: 1715 - DNA, 9 bp, Artificial Sequence
  Synthetic oligonucleotide
agcatggta

SEQ ID NO: 1716 - DNA, 9 bp, Artificial Sequence
  Synthetic oligonucleotide
agcaactgc

SEQ ID NO: 1717 - DNA, 9 bp, Artificial Sequence
  Synthetic oligonucleotide
ggctgagtc

SEQ ID NO: 1718 - DNA, 9 bp, Artificial Sequence
  Synthetic oligonucleotide
agcagccca

SEQ ID NO: 1719 - DNA, 9 bp, Artificial Sequence
  Synthetic oligonucleotide
agcaaagtg

SEQ ID NO: 1720 - DNA, 9 bp, Artificial Sequence
  Synthetic oligonucleotide
agaaaagtc

SEQ ID NO: 1721 - DNA, 9 bp, Artificial Sequence
  Synthetic oligonucleotide
aacaacttc

SEQ ID NO: 1722 - DNA, 9 bp, Artificial Sequence
  Synthetic oligonucleotide
tgcggagtc

SEQ ID NO: 1723 - DNA, 9 bp, Artificial Sequence
  Synthetic oligonucleotide
agaatggtc

SEQ ID NO: 1724 - DNA, 9 bp, Artificial Sequence
  Synthetic oligonucleotide
agcagcaga

SEQ ID NO: 1725 - DNA, 9 bp, Artificial Sequence
  Synthetic oligonucleotide
agcagcaga

SEQ ID NO: 1726 - DNA, 9 bp, Artificial Sequence
  Synthetic oligonucleotide
agttgcttc

SEQ ID NO: 1727 - DNA, 9 bp, Artificial Sequence
  Synthetic oligonucleotide
gacagggtc

SEQ ID NO: 1728 - DNA, 9 bp, Artificial Sequence
  Synthetic oligonucleotide
ggaagagtc

SEQ ID NO: 1729 - DNA, 9 bp, Artificial Sequence
  Synthetic oligonucleotide
ggaagagtc

SEQ ID NO: 1730 - DNA, 9 bp, Artificial Sequence
  Synthetic oligonucleotide
aggggggtc

SEQ ID NO: 1731 - DNA, 9 bp, Artificial Sequence
  Synthetic oligonucleotide
aacaacttc

SEQ ID NO: 1732 - DNA, 9 bp, Artificial Sequence
  Synthetic oligonucleotide
accaaggtc

SEQ ID NO: 1733 - DNA, 9 bp, Artificial Sequence
  Synthetic oligonucleotide
ggccacgtc

SEQ ID NO: 1734 - DNA, 9 bp, Artificial Sequence
  Synthetic oligonucleotide
agcaaggtt

SEQ ID NO: 1735 - DNA, 9 bp, Artificial Sequence
  Synthetic oligonucleotide
agtagggtt

SEQ ID NO: 1736 - DNA, 9 bp, Artificial Sequence
  Synthetic oligonucleotide
agcagcgtc

SEQ ID NO: 1737 - DNA, 9 bp, Artificial Sequence
  Synthetic oligonucleotide
agcagcgtc

SEQ ID NO: 1738 - DNA, 9 bp, Artificial Sequence
  Synthetic oligonucleotide
agcagcgtc

SEQ ID NO: 1739 - DNA, 9 bp, Artificial Sequence
  Synthetic oligonucleotide
agcagcggc

SEQ ID NO: 1740 - DNA, 9 bp, Artificial Sequence
  Synthetic oligonucleotide
agcagcgtt

SEQ ID NO: 1741 - DNA, 9 bp, Artificial Sequence
  Synthetic oligonucleotide
agcaacgtc

SEQ ID NO: 1742 - DNA, 9 bp, Artificial Sequence
  Synthetic oligonucleotide
agcagcggc

SEQ ID NO: 1743 - DNA, 9 bp, Artificial Sequence
  Synthetic oligonucleotide
agcaacgtc

SEQ ID NO: 1744 - DNA, 9 bp, Artificial Sequence
  Synthetic oligonucleotide
agcaacgtc

SEQ ID NO: 1745 - DNA, 9 bp, Artificial Sequence
  Synthetic oligonucleotide
agcagtgtc

SEQ ID NO: 1746 - DNA, 9 bp, Artificial Sequence
  Synthetic oligonucleotide
agcagcggc

SEQ ID NO: 1747 - DNA, 9 bp, Artificial Sequence
  Synthetic oligonucleotide
agcaacgtc

SEQ ID NO: 1748 - DNA, 9 bp, Artificial Sequence
  Synthetic oligonucleotide
agcaacgtc

SEQ ID NO: 1749 - DNA, 9 bp, Artificial Sequence
  Synthetic oligonucleotide
atcagcgtc

SEQ ID NO: 1750 - DNA, 9 bp, Artificial Sequence
  Synthetic oligonucleotide
agcaacgtc

SEQ ID NO: 1751 - DNA, 9 bp, Artificial Sequence
  Synthetic oligonucleotide
agcaacgtc

SEQ ID NO: 1752 - DNA, 9 bp, Artificial Sequence
  Synthetic oligonucleotide
agcagtgtc

SEQ ID NO: 1753 - DNA, 9 bp, Artificial Sequence
  Synthetic oligonucleotide
agcagcgtt

SEQ ID NO: 1754 - DNA, 9 bp, Artificial Sequence
  Synthetic oligonucleotide
agcaacgtc

SEQ ID NO: 1755 - DNA, 9 bp, Artificial Sequence
  Synthetic oligonucleotide
agcaccgtc

SEQ ID NO: 1756 - DNA, 9 bp, Artificial Sequence
  Synthetic oligonucleotide
agcaacgtc

SEQ ID NO: 1757 - DNA, 9 bp, Artificial Sequence
  Synthetic oligonucleotide
agcattgtc

SEQ ID NO: 1758 - DNA, 9 bp, Artificial Sequence
  Synthetic oligonucleotide
agcagcgat

SEQ ID NO: 1759 - DNA, 9 bp, Artificial Sequence
  Synthetic oligonucleotide
agctgtgtc

SEQ ID NO: 1760 - DNA, 9 bp, Artificial Sequence
  Synthetic oligonucleotide
agcatggtc

SEQ ID NO: 1761 - DNA, 9 bp, Artificial Sequence
  Synthetic oligonucleotide
agcatggtc

SEQ ID NO: 1762 - DNA, 9 bp, Artificial Sequence
  Synthetic oligonucleotide
agcatcttc

SEQ ID NO: 1763 - DNA, 9 bp, Artificial Sequence
  Synthetic oligonucleotide
agcatggtc

SEQ ID NO: 1764 - DNA, 9 bp, Artificial Sequence
  Synthetic oligonucleotide
agcatagtc

SEQ ID NO: 1765 - DNA, 9 bp, Artificial Sequence
  Synthetic oligonucleotide
agcatggtc

SEQ ID NO: 1766 - DNA, 9 bp, Artificial Sequence
  Synthetic oligonucleotide
agcatggtc

SEQ ID NO: 1767 - DNA, 9 bp, Artificial Sequence
  Synthetic oligonucleotide
agcatagtc

SEQ ID NO: 1768 - DNA, 9 bp, Artificial Sequence
  Synthetic oligonucleotide
agcaaagtc

SEQ ID NO: 1769 - DNA, 9 bp, Artificial Sequence
  Synthetic oligonucleotide
agcagcgca

SEQ ID NO: 1770 - DNA, 9 bp, Artificial Sequence
  Synthetic oligonucleotide
atcaacgtc

SEQ ID NO: 1771 - DNA, 9 bp, Artificial Sequence
  Synthetic oligonucleotide
agtagtgtc

SEQ ID NO: 1772 - DNA, 9 bp, Artificial Sequence
  Synthetic oligonucleotide
agcaaagtc

SEQ ID NO: 1773 - DNA, 9 bp, Artificial Sequence
  Synthetic oligonucleotide
agccacgtc

SEQ ID NO: 1774 - DNA, 9 bp, Artificial Sequence
  Synthetic oligonucleotide
agcatggtc

SEQ ID NO: 1775 - DNA, 9 bp, Artificial Sequence
  Synthetic oligonucleotide
agcagagtt

SEQ ID NO: 1776 - DNA, 9 bp, Artificial Sequence
  Synthetic oligonucleotide
agcattgtc

SEQ ID NO: 1777 - DNA, 9 bp, Artificial Sequence
  Synthetic oligonucleotide
agcatggtc

SEQ ID NO: 1778 - DNA, 9 bp, Artificial Sequence
  Synthetic oligonucleotide
agcatggtc

SEQ ID NO: 1779 - DNA, 9 bp, Artificial Sequence
  Synthetic oligonucleotide
agcatggtc

SEQ ID NO: 1780 - DNA, 9 bp, Artificial Sequence
  Synthetic oligonucleotide
agctgtgtc

SEQ ID NO: 1781 - DNA, 9 bp, Artificial Sequence
  Synthetic oligonucleotide
agtagagtc

SEQ ID NO: 1782 - DNA, 9 bp, Artificial Sequence
  Synthetic oligonucleotide
agcatggtc

SEQ ID NO: 1783 - DNA, 9 bp, Artificial Sequence
  Synthetic oligonucleotide
agctgtgtc

SEQ ID NO: 1784 - DNA, 9 bp, Artificial Sequence
  Synthetic oligonucleotide
agcaacttc

SEQ ID NO: 1785 - DNA, 9 bp, Artificial Sequence
  Synthetic oligonucleotide
agctgagtc

SEQ ID NO: 1786 - DNA, 9 bp, Artificial Sequence
  Synthetic oligonucleotide
agtagggtc

SEQ ID NO: 1787 - DNA, 9 bp, Artificial Sequence
  Synthetic oligonucleotide
agctgtgtc

SEQ ID NO: 1788 - DNA, 9 bp, Artificial Sequence
  Synthetic oligonucleotide
agcaacatc

SEQ ID NO: 1789 - DNA, 9 bp, Artificial Sequence
  Synthetic oligonucleotide
agcatcgtg

SEQ ID NO: 1790 - DNA, 9 bp, Artificial Sequence
  Synthetic oligonucleotide
agcatggtc

SEQ ID NO: 1791 - DNA, 9 bp, Artificial Sequence
  Synthetic oligonucleotide
agcaacttc

SEQ ID NO: 1792 - DNA, 9 bp, Artificial Sequence
  Synthetic oligonucleotide
agcatggtc

SEQ ID NO: 1793 - DNA, 9 bp, Artificial Sequence
  Synthetic oligonucleotide
agcatggtc

SEQ ID NO: 1794 - DNA, 9 bp, Artificial Sequence
  Synthetic oligonucleotide
agcaaggtc

SEQ ID NO: 1795 - DNA, 9 bp, Artificial Sequence
  Synthetic oligonucleotide
agcatggtc

SEQ ID NO: 1796 - DNA, 9 bp, Artificial Sequence
  Synthetic oligonucleotide
agcagggta

SEQ ID NO: 1797 - DNA, 9 bp, Artificial Sequence
  Synthetic oligonucleotide
ggcagagtc

SEQ ID NO: 1798 - DNA, 9 bp, Artificial Sequence
  Synthetic oligonucleotide
agtaacgtc

SEQ ID NO: 1799 - DNA, 9 bp, Artificial Sequence
  Synthetic oligonucleotide
agcatggtc

SEQ ID NO: 1800 - DNA, 9 bp, Artificial Sequence
  Synthetic oligonucleotide
agcagtgtg

SEQ ID NO: 1801 - DNA, 9 bp, Artificial Sequence
  Synthetic oligonucleotide
agcaccatc

SEQ ID NO: 1802 - DNA, 9 bp, Artificial Sequence
  Synthetic oligonucleotide
agcaacgtg

SEQ ID NO: 1803 - DNA, 9 bp, Artificial Sequence
  Synthetic oligonucleotide
agcaacggc

SEQ ID NO: 1804 - DNA, 9 bp, Artificial Sequence
  Synthetic oligonucleotide
agtagagtc

SEQ ID NO: 1805 - DNA, 9 bp, Artificial Sequence
  Synthetic oligonucleotide
ggcaccgtc

SEQ ID NO: 1806 - DNA, 9 bp, Artificial Sequence
  Synthetic oligonucleotide
agcatggtc

SEQ ID NO: 1807 - DNA, 9 bp, Artificial Sequence
  Synthetic oligonucleotide
agcatagtc

SEQ ID NO: 1808 - DNA, 9 bp, Artificial Sequence
  Synthetic oligonucleotide
agtaacgtc

SEQ ID NO: 1809 - DNA, 9 bp, Artificial Sequence
  Synthetic oligonucleotide
agcatagtg

SEQ ID NO: 1810 - DNA, 9 bp, Artificial Sequence
  Synthetic oligonucleotide
atcagggtg

SEQ ID NO: 1811 - DNA, 9 bp, Artificial Sequence
  Synthetic oligonucleotide
tacagagtc

SEQ ID NO: 1812 - DNA, 9 bp, Artificial Sequence
  Synthetic oligonucleotide
atgagggtc

SEQ ID NO: 1813 - DNA, 9 bp, Artificial Sequence
  Synthetic oligonucleotide
agcaaattc

SEQ ID NO: 1814 - DNA, 9 bp, Artificial Sequence
  Synthetic oligonucleotide
agcaaagtg

SEQ ID NO: 1815 - DNA, 9 bp, Artificial Sequence
  Synthetic oligonucleotide
ataagtgtc

SEQ ID NO: 1816 - DNA, 9 bp, Artificial Sequence
  Synthetic oligonucleotide
agtagtctc

SEQ ID NO: 1817 - DNA, 9 bp, Artificial Sequence
  Synthetic oligonucleotide
cgcagcaac

SEQ ID NO: 1818 - DNA, 9 bp, Artificial Sequence
  Synthetic oligonucleotide
agcaatgtg

SEQ ID NO: 1819 - DNA, 9 bp, Artificial Sequence
  Synthetic oligonucleotide
accaaagtc

SEQ ID NO: 1820 - DNA, 9 bp, Artificial Sequence
  Synthetic oligonucleotide
agtagtgtt

SEQ ID NO: 1821 - DNA, 9 bp, Artificial Sequence
  Synthetic oligonucleotide
agcatagtg

SEQ ID NO: 1822 - DNA, 9 bp, Artificial Sequence
  Synthetic oligonucleotide
atcaccatc

SEQ ID NO: 1823 - DNA, 9 bp, Artificial Sequence
  Synthetic oligonucleotide
agaatcgtt

SEQ ID NO: 1824 - DNA, 9 bp, Artificial Sequence
  Synthetic oligonucleotide
agtaacatc

SEQ ID NO: 1825 - DNA, 9 bp, Artificial Sequence
  Synthetic oligonucleotide
aggacagtc

SEQ ID NO: 1826 - DNA, 9 bp, Artificial Sequence
  Synthetic oligonucleotide
ggcagtgtt

SEQ ID NO: 1827 - DNA, 9 bp, Artificial Sequence
  Synthetic oligonucleotide
agttgtgtc

SEQ ID NO: 1828 - DNA, 9 bp, Artificial Sequence
  Synthetic oligonucleotide
cccaccgtc

SEQ ID NO: 1829 - DNA, 9 bp, Artificial Sequence
  Synthetic oligonucleotide
agtaccggc

SEQ ID NO: 1830 - DNA, 9 bp, Artificial Sequence
  Synthetic oligonucleotide
agcaacttt

SEQ ID NO: 1831 - DNA, 9 bp, Artificial Sequence
  Synthetic oligonucleotide
agcaagggc

SEQ ID NO: 1832 - DNA, 9 bp, Artificial Sequence
  Synthetic oligonucleotide
gtcagggtc

SEQ ID NO: 1833 - DNA, 9 bp, Artificial Sequence
  Synthetic oligonucleotide
aggaaagtc

SEQ ID NO: 1834 - DNA, 9 bp, Artificial Sequence
  Synthetic oligonucleotide
cacagtgtc

SEQ ID NO: 1835 - DNA, 9 bp, Artificial Sequence
  Synthetic oligonucleotide
gtcagtgtc

SEQ ID NO: 1836 - DNA, 9 bp, Artificial Sequence
  Synthetic oligonucleotide
atcaccatc

SEQ ID NO: 1837 - DNA, 9 bp, Artificial Sequence
  Synthetic oligonucleotide
atcaacatc

SEQ ID NO: 1838 - DNA, 9 bp, Artificial Sequence
  Synthetic oligonucleotide
ccgagcgtc

SEQ ID NO: 1839 - DNA, 9 bp, Artificial Sequence
  Synthetic oligonucleotide
agcacagtg

SEQ ID NO: 1840 - DNA, 9 bp, Artificial Sequence
  Synthetic oligonucleotide
aacattgtc

SEQ ID NO: 1841 - DNA, 9 bp, Artificial Sequence
  Synthetic oligonucleotide
aacattgtc

SEQ ID NO: 1842 - DNA, 9 bp, Artificial Sequence
  Synthetic oligonucleotide
aacattgtc

SEQ ID NO: 1843 - DNA, 9 bp, Artificial Sequence
  Synthetic oligonucleotide
agtaccggc

SEQ ID NO: 1844 - DNA, 9 bp, Artificial Sequence
  Synthetic oligonucleotide
agtacagtc

SEQ ID NO: 1845 - DNA, 9 bp, Artificial Sequence
  Synthetic oligonucleotide
aacaacatc

SEQ ID NO: 1846 - DNA, 9 bp, Artificial Sequence
  Synthetic oligonucleotide
tcccgcgtc

SEQ ID NO: 1847 - DNA, 9 bp, Artificial Sequence
  Synthetic oligonucleotide
aggggagtc

SEQ ID NO: 1848 - DNA, 9 bp, Artificial Sequence
  Synthetic oligonucleotide
agtagctgc

SEQ ID NO: 1849 - DNA, 9 bp, Artificial Sequence
  Synthetic oligonucleotide
ggaagggtc

SEQ ID NO: 1850 - DNA, 9 bp, Artificial Sequence
  Synthetic oligonucleotide
ggaagggtc

SEQ ID NO: 1851 - DNA, 9 bp, Artificial Sequence
  Synthetic oligonucleotide
ggaagggtc

SEQ ID NO: 1852 - DNA, 9 bp, Artificial Sequence
  Synthetic oligonucleotide
ggaagggtc

SEQ ID NO: 1853 - DNA, 9 bp, Artificial Sequence
  Synthetic oligonucleotide
ggaagggtc

SEQ ID NO: 1854 - DNA, 9 bp, Artificial Sequence
  Synthetic oligonucleotide
ggaagggtc

SEQ ID NO: 1855 - DNA, 9 bp, Artificial Sequence
  Synthetic oligonucleotide
ctcagtgtc

SEQ ID NO: 1856 - DNA, 9 bp, Artificial Sequence
  Synthetic oligonucleotide
agtaaagtc

SEQ ID NO: 1857 - DNA, 9 bp, Artificial Sequence
  Synthetic oligonucleotide
aacggggtc

SEQ ID NO: 1858 - DNA, 9 bp, Artificial Sequence
  Synthetic oligonucleotide
gggagggtc

SEQ ID NO: 1859 - DNA, 9 bp, Artificial Sequence
  Synthetic oligonucleotide
ggcagggtt

SEQ ID NO: 1860 - DNA, 9 bp, Artificial Sequence
  Synthetic oligonucleotide
aggggagtc

SEQ ID NO: 1861 - DNA, 9 bp, Artificial Sequence
  Synthetic oligonucleotide
aacaatgtc

SEQ ID NO: 1862 - DNA, 9 bp, Artificial Sequence
  Synthetic oligonucleotide
agcttggtc

SEQ ID NO: 1863 - DNA, 9 bp, Artificial Sequence
  Synthetic oligonucleotide
atgagggtc

SEQ ID NO: 1864 - DNA, 9 bp, Artificial Sequence
  Synthetic oligonucleotide
gccagtgtc

SEQ ID NO: 1865 - DNA, 9 bp, Artificial Sequence
  Synthetic oligonucleotide
atcacagtc

SEQ ID NO: 1866 - DNA, 9 bp, Artificial Sequence
  Synthetic oligonucleotide
gacagggtc

SEQ ID NO: 1867 - DNA, 9 bp, Artificial Sequence
  Synthetic oligonucleotide
agccttgtc

SEQ ID NO: 1868 - DNA, 9 bp, Artificial Sequence
  Synthetic oligonucleotide
ggcagcggt

SEQ ID NO: 1869 - DNA, 9 bp, Artificial Sequence
  Synthetic oligonucleotide
tccagtgtc

SEQ ID NO: 1870 - DNA, 9 bp, Artificial Sequence
  Synthetic oligonucleotide
agcagctgt

SEQ ID NO: 1871 - DNA, 9 bp, Artificial Sequence
  Synthetic oligonucleotide
agcagctca

SEQ ID NO: 1872 - DNA, 9 bp, Artificial Sequence
  Synthetic oligonucleotide
ggcaacggc

SEQ ID NO: 1873 - DNA, 9 bp, Artificial Sequence
  Synthetic oligonucleotide
agctgagtt

SEQ ID NO: 1874 - DNA, 9 bp, Artificial Sequence
  Synthetic oligonucleotide
agcagcaca

SEQ ID NO: 1875 - DNA, 9 bp, Artificial Sequence
  Synthetic oligonucleotide
agcaacctt

SEQ ID NO: 1876 - DNA, 9 bp, Artificial Sequence
  Synthetic oligonucleotide
agcaaattc

SEQ ID NO: 1877 - DNA, 9 bp, Artificial Sequence
  Synthetic oligonucleotide
agacgggtc

SEQ ID NO: 1878 - DNA, 9 bp, Artificial Sequence
  Synthetic oligonucleotide
gccagagtc

SEQ ID NO: 1879 - DNA, 9 bp, Artificial Sequence
  Synthetic oligonucleotide
agcaacagc

SEQ ID NO: 1880 - DNA, 9 bp, Artificial Sequence
  Synthetic oligonucleotide
aaccgagtc

SEQ ID NO: 1881 - DNA, 9 bp, Artificial Sequence
  Synthetic oligonucleotide
agcagctca

SEQ ID NO: 1882 - DNA, 9 bp, Artificial Sequence
  Synthetic oligonucleotide
ggaagggtc

SEQ ID NO: 1883 - DNA, 9 bp, Artificial Sequence
  Synthetic oligonucleotide
agaacggtc

SEQ ID NO: 1884 - DNA, 9 bp, Artificial Sequence
  Synthetic oligonucleotide
agcaaggta

SEQ ID NO: 1885 - DNA, 9 bp, Artificial Sequence
  Synthetic oligonucleotide
agaatggtc

SEQ ID NO: 1886 - DNA, 9 bp, Artificial Sequence
  Synthetic oligonucleotide
agaatggtc

SEQ ID NO: 1887 - DNA, 9 bp, Artificial Sequence
  Synthetic oligonucleotide
agcaagggc

SEQ ID NO: 1888 - DNA, 9 bp, Artificial Sequence
  Synthetic oligonucleotide
tgctgagtc

SEQ ID NO: 1889 - DNA, 9 bp, Artificial Sequence
  Synthetic oligonucleotide
agcattgtt

SEQ ID NO: 1890 - DNA, 9 bp, Artificial Sequence
  Synthetic oligonucleotide
agcattgtg

SEQ ID NO: 1891 - DNA, 9 bp, Artificial Sequence
  Synthetic oligonucleotide
gctagcgtc

SEQ ID NO: 1892 - DNA, 9 bp, Artificial Sequence
  Synthetic oligonucleotide
agcaacttt

SEQ ID NO: 1893 - DNA, 9 bp, Artificial Sequence
  Synthetic oligonucleotide
agtagggtt

SEQ ID NO: 1894 - DNA, 9 bp, Artificial Sequence
  Synthetic oligonucleotide
ggcagtgtt

SEQ ID NO: 1895 - DNA, 9 bp, Artificial Sequence
  Synthetic oligonucleotide
aactgagtc

SEQ ID NO: 1896 - DNA, 9 bp, Artificial Sequence
  Synthetic oligonucleotide
agcattgtg

SEQ ID NO: 1897 - DNA, 9 bp, Artificial Sequence
  Synthetic oligonucleotide
agcaaggtt

SEQ ID NO: 1898 - DNA, 9 bp, Artificial Sequence
  Synthetic oligonucleotide
ggcaacgtt

SEQ ID NO: 1899 - DNA, 9 bp, Artificial Sequence
  Synthetic oligonucleotide
aacaacctc

SEQ ID NO: 1900 - DNA, 9 bp, Artificial Sequence
  Synthetic oligonucleotide
agggacgtc

SEQ ID NO: 1901 - DNA, 9 bp, Artificial Sequence
  Synthetic oligonucleotide
tccagtgtc

SEQ ID NO: 1902 - DNA, 9 bp, Artificial Sequence
  Synthetic oligonucleotide
agcatggtt

SEQ ID NO: 1903 - DNA, 9 bp, Artificial Sequence
  Synthetic oligonucleotide
aatagggtc

SEQ ID NO: 1904 - DNA, 9 bp, Artificial Sequence
  Synthetic oligonucleotide
agtatagtc

SEQ ID NO: 1905 - DNA, 9 bp, Artificial Sequence
  Synthetic oligonucleotide
tgcaatgtc

SEQ ID NO: 1906 - DNA, 9 bp, Artificial Sequence
  Synthetic oligonucleotide
agctacatc

SEQ ID NO: 1907 - DNA, 9 bp, Artificial Sequence
  Synthetic oligonucleotide
agcaaagta

SEQ ID NO: 1908 - DNA, 9 bp, Artificial Sequence
  Synthetic oligonucleotide
caccccgtc

SEQ ID NO: 1909 - DNA, 9 bp, Artificial Sequence
  Synthetic oligonucleotide
aggcacgtt

SEQ ID NO: 1910 - DNA, 9 bp, Artificial Sequence
  Synthetic oligonucleotide
caccccgtc

SEQ ID NO: 1911 - DNA, 9 bp, Artificial Sequence
  Synthetic oligonucleotide
gcaagagtc

SEQ ID NO: 1912 - DNA, 9 bp, Artificial Sequence
  Synthetic oligonucleotide
agtgcagtc

SEQ ID NO: 1913 - DNA, 9 bp, Artificial Sequence
  Synthetic oligonucleotide
atccacgtt

SEQ ID NO: 1914 - DNA, 9 bp, Artificial Sequence
  Synthetic oligonucleotide
atccacgtt

SEQ ID NO: 1915 - DNA, 9 bp, Artificial Sequence
  Synthetic oligonucleotide
agcagcttc

SEQ ID NO: 1916 - DNA, 9 bp, Artificial Sequence
  Synthetic oligonucleotide
agcagggtc

SEQ ID NO: 1917 - DNA, 9 bp, Artificial Sequence
  Synthetic oligonucleotide
agcagcttc

SEQ ID NO: 1918 - DNA, 9 bp, Artificial Sequence
  Synthetic oligonucleotide
agcagggtc

SEQ ID NO: 1919 - DNA, 9 bp, Artificial Sequence
  Synthetic oligonucleotide
agcaactgc

SEQ ID NO: 1920 - DNA, 9 bp, Artificial Sequence
  Synthetic oligonucleotide
agcaactgc

SEQ ID NO: 1921 - DNA, 9 bp, Artificial Sequence
  Synthetic oligonucleotide
agcagcttc

SEQ ID NO: 1922 - DNA, 9 bp, Artificial Sequence
  Synthetic oligonucleotide
aggtgcctc

SEQ ID NO: 1923 - DNA, 9 bp, Artificial Sequence
  Synthetic oligonucleotide
agctcagtc

SEQ ID NO: 1924 - DNA, 9 bp, Artificial Sequence
  Synthetic oligonucleotide
agcagcgtg

SEQ ID NO: 1925 - DNA, 9 bp, Artificial Sequence
  Synthetic oligonucleotide
agcagcgtg

SEQ ID NO: 1926 - DNA, 9 bp, Artificial Sequence
  Synthetic oligonucleotide
agcagcgtg

SEQ ID NO: 1927 - DNA, 9 bp, Artificial Sequence
  Synthetic oligonucleotide
agcagcgtg

SEQ ID NO: 1928 - DNA, 9 bp, Artificial Sequence
  Synthetic oligonucleotide
agcagcctc

SEQ ID NO: 1929 - DNA, 9 bp, Artificial Sequence
  Synthetic oligonucleotide
agcagcctc

SEQ ID NO: 1930 - DNA, 9 bp, Artificial Sequence
  Synthetic oligonucleotide
aggagcgtc

SEQ ID NO: 1931 - DNA, 9 bp, Artificial Sequence
  Synthetic oligonucleotide
agcagcgac

SEQ ID NO: 1932 - DNA, 9 bp, Artificial Sequence
  Synthetic oligonucleotide
agctgcgtc

SEQ ID NO: 1933 - DNA, 9 bp, Artificial Sequence
  Synthetic oligonucleotide
agcagggtc

SEQ ID NO: 1934 - DNA, 9 bp, Artificial Sequence
  Synthetic oligonucleotide
agcagcatc

SEQ ID NO: 1935 - DNA, 9 bp, Artificial Sequence
  Synthetic oligonucleotide
aggagcgtc

SEQ ID NO: 1936 - DNA, 9 bp, Artificial Sequence
  Synthetic oligonucleotide
agcagcgtg

SEQ ID NO: 1937 - DNA, 9 bp, Artificial Sequence
  Synthetic oligonucleotide
agcagcgtg

SEQ ID NO: 1938 - DNA, 9 bp, Artificial Sequence
  Synthetic oligonucleotide
agcagcatc

SEQ ID NO: 1939 - DNA, 9 bp, Artificial Sequence
  Synthetic oligonucleotide
accagcgtc

SEQ ID NO: 1940 - DNA, 9 bp, Artificial Sequence
  Synthetic oligonucleotide
agcagggtc

SEQ ID NO: 1941 - DNA, 9 bp, Artificial Sequence
  Synthetic oligonucleotide
aggagcgac

SEQ ID NO: 1942 - DNA, 9 bp, Artificial Sequence
  Synthetic oligonucleotide
aggagcgac

SEQ ID NO: 1943 - DNA, 9 bp, Artificial Sequence
  Synthetic oligonucleotide
aggagcgac

SEQ ID NO: 1944 - DNA, 9 bp, Artificial Sequence
  Synthetic oligonucleotide
aggagcgac

SEQ ID NO: 1945 - DNA, 9 bp, Artificial Sequence
  Synthetic oligonucleotide
aggagcgac

SEQ ID NO: 1946 - DNA, 9 bp, Artificial Sequence
  Synthetic oligonucleotide
aggagcgac

SEQ ID NO: 1947 - DNA, 9 bp, Artificial Sequence
  Synthetic oligonucleotide
aggagcgac

SEQ ID NO: 1948 - DNA, 9 bp, Artificial Sequence
  Synthetic oligonucleotide
aggagcgac

SEQ ID NO: 1949 - DNA, 9 bp, Artificial Sequence
  Synthetic oligonucleotide
aggagcgac

SEQ ID NO: 1950 - DNA, 9 bp, Artificial Sequence
  Synthetic oligonucleotide
aggagcgac

SEQ ID NO: 1951 - DNA, 9 bp, Artificial Sequence
  Synthetic oligonucleotide
aggagcgac

SEQ ID NO: 1952 - DNA, 9 bp, Artificial Sequence
  Synthetic oligonucleotide
aggagcgac

SEQ ID NO: 1953 - DNA, 9 bp, Artificial Sequence
  Synthetic oligonucleotide
aggagcgac

SEQ ID NO: 1954 - DNA, 9 bp, Artificial Sequence
  Synthetic oligonucleotide
aggagcgac

SEQ ID NO: 1955 - DNA, 9 bp, Artificial Sequence
  Synthetic oligonucleotide
aggagcgac

SEQ ID NO: 1956 - DNA, 9 bp, Artificial Sequence
  Synthetic oligonucleotide
aggagcgac

SEQ ID NO: 1957 - DNA, 9 bp, Artificial Sequence
  Synthetic oligonucleotide
aggagcgac

SEQ ID NO: 1958 - DNA, 9 bp, Artificial Sequence
  Synthetic oligonucleotide
aggagcgac

SEQ ID NO: 1959 - DNA, 9 bp, Artificial Sequence
  Synthetic oligonucleotide
aggagcgac

SEQ ID NO: 1960 - DNA, 9 bp, Artificial Sequence
  Synthetic oligonucleotide
aggagcgac

SEQ ID NO: 1961 - DNA, 9 bp, Artificial Sequence
  Synthetic oligonucleotide
aggagcgac

SEQ ID NO: 1962 - DNA, 9 bp, Artificial Sequence
  Synthetic oligonucleotide
aggagcgac

SEQ ID NO: 1963 - DNA, 9 bp, Artificial Sequence
  Synthetic oligonucleotide
aggagcgac

SEQ ID NO: 1964 - DNA, 9 bp, Artificial Sequence
  Synthetic oligonucleotide
aggagcgac

SEQ ID NO: 1965 - DNA, 9 bp, Artificial Sequence
  Synthetic oligonucleotide
aggagcgac

SEQ ID NO: 1966 - DNA, 9 bp, Artificial Sequence
  Synthetic oligonucleotide
aggagcgac

SEQ ID NO: 1967 - DNA, 9 bp, Artificial Sequence
  Synthetic oligonucleotide
aggagcgac

SEQ ID NO: 1968 - DNA, 9 bp, Artificial Sequence
  Synthetic oligonucleotide
aggagcgac

SEQ ID NO: 1969 - DNA, 9 bp, Artificial Sequence
  Synthetic oligonucleotide
aggagcgac

SEQ ID NO: 1970 - DNA, 9 bp, Artificial Sequence
  Synthetic oligonucleotide
aggagcgac

SEQ ID NO: 1971 - DNA, 9 bp, Artificial Sequence
  Synthetic oligonucleotide
aggagcgac

SEQ ID NO: 1972 - DNA, 9 bp, Artificial Sequence
  Synthetic oligonucleotide
aggagcgac

SEQ ID NO: 1973 - DNA, 9 bp, Artificial Sequence
  Synthetic oligonucleotide
aggagcgac

SEQ ID NO: 1974 - DNA, 9 bp, Artificial Sequence
  Synthetic oligonucleotide
aggagcgac

SEQ ID NO: 1975 - DNA, 9 bp, Artificial Sequence
  Synthetic oligonucleotide
aacagcctc

SEQ ID NO: 1976 - DNA, 9 bp, Artificial Sequence
  Synthetic oligonucleotide
agaagcatc

SEQ ID NO: 1977 - DNA, 9 bp, Artificial Sequence
  Synthetic oligonucleotide
agaagcctc

SEQ ID NO: 1978 - DNA, 9 bp, Artificial Sequence
  Synthetic oligonucleotide
agcagcgtc

SEQ ID NO: 1979 - DNA, 9 bp, Artificial Sequence
  Synthetic oligonucleotide
agcagcgtc

SEQ ID NO: 1980 - DNA, 9 bp, Artificial Sequence
  Synthetic oligonucleotide
agcagcgtc

SEQ ID NO: 1981 - DNA, 9 bp, Artificial Sequence
  Synthetic oligonucleotide
agcagcgtc

SEQ ID NO: 1982 - DNA, 9 bp, Artificial Sequence
  Synthetic oligonucleotide
agcagcgtc

SEQ ID NO: 1983 - DNA, 9 bp, Artificial Sequence
  Synthetic oligonucleotide
agcagcgtc

SEQ ID NO: 1984 - DNA, 9 bp, Artificial Sequence
  Synthetic oligonucleotide
agcagcgtc

SEQ ID NO: 1985 - DNA, 9 bp, Artificial Sequence
  Synthetic oligonucleotide
agcagcgtc

SEQ ID NO: 1986 - DNA, 9 bp, Artificial Sequence
  Synthetic oligonucleotide
agcagcgtc

SEQ ID NO: 1987 - DNA, 9 bp, Artificial Sequence
  Synthetic oligonucleotide
agcagcgtc

SEQ ID NO: 1988 - DNA, 9 bp, Artificial Sequence
  Synthetic oligonucleotide
agcagcgtc

SEQ ID NO: 1989 - DNA, 9 bp, Artificial Sequence
  Synthetic oligonucleotide
agcagcgtc

SEQ ID NO: 1990 - DNA, 9 bp, Artificial Sequence
  Synthetic oligonucleotide
agcagcgtc

SEQ ID NO: 1991 - DNA, 9 bp, Artificial Sequence
  Synthetic oligonucleotide
agcagcgtc

SEQ ID NO: 1992 - DNA, 9 bp, Artificial Sequence
  Synthetic oligonucleotide
agcagcgtc

SEQ ID NO: 1993 - DNA, 9 bp, Artificial Sequence
  Synthetic oligonucleotide
agcagcgtc

SEQ ID NO: 1994 - DNA, 9 bp, Artificial Sequence
  Synthetic oligonucleotide
agcagcgtc

SEQ ID NO: 1995 - DNA, 9 bp, Artificial Sequence
  Synthetic oligonucleotide
agcagcgtc

SEQ ID NO: 1996 - DNA, 9 bp, Artificial Sequence
  Synthetic oligonucleotide
agcagcgtc

SEQ ID NO: 1997 - DNA, 9 bp, Artificial Sequence
  Synthetic oligonucleotide
agcagcgtc

SEQ ID NO: 1998 - DNA, 9 bp, Artificial Sequence
  Synthetic oligonucleotide
agcagcgtc

SEQ ID NO: 1999 - DNA, 9 bp, Artificial Sequence
  Synthetic oligonucleotide
agcagtgtc

SEQ ID NO: 2000 - DNA, 9 bp, Artificial Sequence
  Synthetic oligonucleotide
agcagagtc

SEQ ID NO: 2001 - DNA, 9 bp, Artificial Sequence
  Synthetic oligonucleotide
atcagcgtc

SEQ ID NO: 2002 - DNA, 9 bp, Artificial Sequence
  Synthetic oligonucleotide
agcagagtc

SEQ ID NO: 2003 - DNA, 9 bp, Artificial Sequence
  Synthetic oligonucleotide
aacagcgtc

SEQ ID NO: 2004 - DNA, 9 bp, Artificial Sequence
  Synthetic oligonucleotide
tgcagcgtc

SEQ ID NO: 2005 - DNA, 9 bp, Artificial Sequence
  Synthetic oligonucleotide
agcagcttc

SEQ ID NO: 2006 - DNA, 9 bp, Artificial Sequence
  Synthetic oligonucleotide
agcagtgtc

SEQ ID NO: 2007 - DNA, 9 bp, Artificial Sequence
  Synthetic oligonucleotide
agcagcatc

SEQ ID NO: 2008 - DNA, 9 bp, Artificial Sequence
  Synthetic oligonucleotide
agcagtgtc

SEQ ID NO: 2009 - DNA, 9 bp, Artificial Sequence
  Synthetic oligonucleotide
agcagcttc

SEQ ID NO: 2010 - DNA, 9 bp, Artificial Sequence
  Synthetic oligonucleotide
agcagagtc

SEQ ID NO: 2011 - DNA, 9 bp, Artificial Sequence
  Synthetic oligonucleotide
agcagggtc

SEQ ID NO: 2012 - DNA, 9 bp, Artificial Sequence
  Synthetic oligonucleotide
agctgcgtc

SEQ ID NO: 2013 - DNA, 9 bp, Artificial Sequence
  Synthetic oligonucleotide
agcagcgta

SEQ ID NO: 2014 - DNA, 9 bp, Artificial Sequence
  Synthetic oligonucleotide
agcagcctc

SEQ ID NO: 2015 - DNA, 9 bp, Artificial Sequence
  Synthetic oligonucleotide
agcagcgtt

SEQ ID NO: 2016 - DNA, 9 bp, Artificial Sequence
  Synthetic oligonucleotide
agcagcctc

SEQ ID NO: 2017 - DNA, 9 bp, Artificial Sequence
  Synthetic oligonucleotide
agcagtgtc

SEQ ID NO: 2018 - DNA, 9 bp, Artificial Sequence
  Synthetic oligonucleotide
agcagtgtc

SEQ ID NO: 2019 - DNA, 9 bp, Artificial Sequence
  Synthetic oligonucleotide
agcagcatc

SEQ ID NO: 2020 - DNA, 9 bp, Artificial Sequence
  Synthetic oligonucleotide
agcagcatc

SEQ ID NO: 2021 - DNA, 9 bp, Artificial Sequence
  Synthetic oligonucleotide
agcagggtc

SEQ ID NO: 2022 - DNA, 9 bp, Artificial Sequence
  Synthetic oligonucleotide
atcagcgtc

SEQ ID NO: 2023 - DNA, 9 bp, Artificial Sequence
  Synthetic oligonucleotide
agcagcatc

SEQ ID NO: 2024 - DNA, 9 bp, Artificial Sequence
  Synthetic oligonucleotide
agcagcatc

SEQ ID NO: 2025 - DNA, 9 bp, Artificial Sequence
  Synthetic oligonucleotide
agcagcatc

SEQ ID NO: 2026 - DNA, 9 bp, Artificial Sequence
  Synthetic oligonucleotide
agcagcatc

SEQ ID NO: 2027 - DNA, 9 bp, Artificial Sequence
  Synthetic oligonucleotide
agcagtgtc

SEQ ID NO: 2028 - DNA, 9 bp, Artificial Sequence
  Synthetic oligonucleotide
agcagcttc

SEQ ID NO: 2029 - DNA, 9 bp, Artificial Sequence
  Synthetic oligonucleotide
agcagcgtg

SEQ ID NO: 2030 - DNA, 9 bp, Artificial Sequence
  Synthetic oligonucleotide
agtagcgtc

SEQ ID NO: 2031 - DNA, 9 bp, Artificial Sequence
  Synthetic oligonucleotide
agcagcttc

SEQ ID NO: 2032 - DNA, 9 bp, Artificial Sequence
  Synthetic oligonucleotide
agcagcgtg

SEQ ID NO: 2033 - DNA, 9 bp, Artificial Sequence
  Synthetic oligonucleotide
atcagcgtc

SEQ ID NO: 2034 - DNA, 9 bp, Artificial Sequence
  Synthetic oligonucleotide
agcagcatc

SEQ ID NO: 2035 - DNA, 9 bp, Artificial Sequence
  Synthetic oligonucleotide
agcagtgtc

SEQ ID NO: 2036 - DNA, 9 bp, Artificial Sequence
  Synthetic oligonucleotide
agcagcgac

SEQ ID NO: 2037 - DNA, 9 bp, Artificial Sequence
  Synthetic oligonucleotide
agcagtgtc

SEQ ID NO: 2038 - DNA, 9 bp, Artificial Sequence
  Synthetic oligonucleotide
agcagcgtg

SEQ ID NO: 2039 - DNA, 9 bp, Artificial Sequence
  Synthetic oligonucleotide
agcagcttc

SEQ ID NO: 2040 - DNA, 9 bp, Artificial Sequence
  Synthetic oligonucleotide
agcagagtc

SEQ ID NO: 2041 - DNA, 9 bp, Artificial Sequence
  Synthetic oligonucleotide
agcagcttc

SEQ ID NO: 2042 - DNA, 9 bp, Artificial Sequence
  Synthetic oligonucleotide
agcagtgtc

SEQ ID NO: 2043 - DNA, 9 bp, Artificial Sequence
  Synthetic oligonucleotide
agccgcgtc

SEQ ID NO: 2044 - DNA, 9 bp, Artificial Sequence
  Synthetic oligonucleotide
tgcagcgtc

SEQ ID NO: 2045 - DNA, 9 bp, Artificial Sequence
  Synthetic oligonucleotide
agcagcatc

SEQ ID NO: 2046 - DNA, 9 bp, Artificial Sequence
  Synthetic oligonucleotide
agcagcgtg

SEQ ID NO: 2047 - DNA, 9 bp, Artificial Sequence
  Synthetic oligonucleotide
agcagtgtc

SEQ ID NO: 2048 - DNA, 9 bp, Artificial Sequence
  Synthetic oligonucleotide
agcagcgcc

SEQ ID NO: 2049 - DNA, 9 bp, Artificial Sequence
  Synthetic oligonucleotide
agcagcatc

SEQ ID NO: 2050 - DNA, 9 bp, Artificial Sequence
  Synthetic oligonucleotide
agcagcctc

SEQ ID NO: 2051 - DNA, 9 bp, Artificial Sequence
  Synthetic oligonucleotide
ggcagcgtc

SEQ ID NO: 2052 - DNA, 9 bp, Artificial Sequence
  Synthetic oligonucleotide
agcagcctc

SEQ ID NO: 2053 - DNA, 9 bp, Artificial Sequence
  Synthetic oligonucleotide
agcagagtc

SEQ ID NO: 2054 - DNA, 9 bp, Artificial Sequence
  Synthetic oligonucleotide
tgcagcgtc

SEQ ID NO: 2055 - DNA, 9 bp, Artificial Sequence
  Synthetic oligonucleotide
agcagggtc

SEQ ID NO: 2056 - DNA, 9 bp, Artificial Sequence
  Synthetic oligonucleotide
agcagagtc

SEQ ID NO: 2057 - DNA, 9 bp, Artificial Sequence
  Synthetic oligonucleotide
agcagggtc

SEQ ID NO: 2058 - DNA, 9 bp, Artificial Sequence
  Synthetic oligonucleotide
agcagcctc

SEQ ID NO: 2059 - DNA, 9 bp, Artificial Sequence
  Synthetic oligonucleotide
agcagcggc

SEQ ID NO: 2060 - DNA, 9 bp, Artificial Sequence
  Synthetic oligonucleotide
agcagggtc

SEQ ID NO: 2061 - DNA, 9 bp, Artificial Sequence
  Synthetic oligonucleotide
agcagtgtc

SEQ ID NO: 2062 - DNA, 9 bp, Artificial Sequence
  Synthetic oligonucleotide
agcagcggc

SEQ ID NO: 2063 - DNA, 9 bp, Artificial Sequence
  Synthetic oligonucleotide
agcagcatc

SEQ ID NO: 2064 - DNA, 9 bp, Artificial Sequence
  Synthetic oligonucleotide
agcagggtc

SEQ ID NO: 2065 - DNA, 9 bp, Artificial Sequence
  Synthetic oligonucleotide
agcagggtc

SEQ ID NO: 2066 - DNA, 9 bp, Artificial Sequence
  Synthetic oligonucleotide
agcagtgtc

SEQ ID NO: 2067 - DNA, 9 bp, Artificial Sequence
  Synthetic oligonucleotide
agcagcctc

SEQ ID NO: 2068 - DNA, 9 bp, Artificial Sequence
  Synthetic oligonucleotide
agcagcgcc

SEQ ID NO: 2069 - DNA, 9 bp, Artificial Sequence
  Synthetic oligonucleotide
agcagcgac

SEQ ID NO: 2070 - DNA, 9 bp, Artificial Sequence
  Synthetic oligonucleotide
agcagcttc

SEQ ID NO: 2071 - DNA, 9 bp, Artificial Sequence
  Synthetic oligonucleotide
agcagggtc

SEQ ID NO: 2072 - DNA, 9 bp, Artificial Sequence
  Synthetic oligonucleotide
agcagcgac

SEQ ID NO: 2073 - DNA, 9 bp, Artificial Sequence
  Synthetic oligonucleotide
agcagcgtg

SEQ ID NO: 2074 - DNA, 9 bp, Artificial Sequence
  Synthetic oligonucleotide
ggcagcgtc

SEQ ID NO: 2075 - DNA, 9 bp, Artificial Sequence
  Synthetic oligonucleotide
agcagcctc

SEQ ID NO: 2076 - DNA, 9 bp, Artificial Sequence
  Synthetic oligonucleotide
agcagcctc

SEQ ID NO: 2077 - DNA, 9 bp, Artificial Sequence
  Synthetic oligonucleotide
tgcagcgtc

SEQ ID NO: 2078 - DNA, 9 bp, Artificial Sequence
  Synthetic oligonucleotide
agcagtgtc

SEQ ID NO: 2079 - DNA, 9 bp, Artificial Sequence
  Synthetic oligonucleotide
agcaacgtc

SEQ ID NO: 2080 - DNA, 9 bp, Artificial Sequence
  Synthetic oligonucleotide
agcagcatc

SEQ ID NO: 2081 - DNA, 9 bp, Artificial Sequence
  Synthetic oligonucleotide
agcagcctc

SEQ ID NO: 2082 - DNA, 9 bp, Artificial Sequence
  Synthetic oligonucleotide
agcagggtc

SEQ ID NO: 2083 - DNA, 9 bp, Artificial Sequence
  Synthetic oligonucleotide
agcagcggc

SEQ ID NO: 2084 - DNA, 9 bp, Artificial Sequence
  Synthetic oligonucleotide
agcagggtc

SEQ ID NO: 2085 - DNA, 9 bp, Artificial Sequence
  Synthetic oligonucleotide
agcagcatc

SEQ ID NO: 2086 - DNA, 9 bp, Artificial Sequence
  Synthetic oligonucleotide
agcagagtc

SEQ ID NO: 2087 - DNA, 9 bp, Artificial Sequence
  Synthetic oligonucleotide
agcagcgcc

SEQ ID NO: 2088 - DNA, 9 bp, Artificial Sequence
  Synthetic oligonucleotide
agcagcggc

SEQ ID NO: 2089 - DNA, 9 bp, Artificial Sequence
  Synthetic oligonucleotide
agcagcctc

SEQ ID NO: 2090 - DNA, 9 bp, Artificial Sequence
  Synthetic oligonucleotide
agcatcgtc

SEQ ID NO: 2091 - DNA, 9 bp, Artificial Sequence
  Synthetic oligonucleotide
ggcagcgtc

SEQ ID NO: 2092 - DNA, 9 bp, Artificial Sequence
  Synthetic oligonucleotide
agcagcctc

SEQ ID NO: 2093 - DNA, 9 bp, Artificial Sequence
  Synthetic oligonucleotide
agcagtgtc

SEQ ID NO: 2094 - DNA, 9 bp, Artificial Sequence
  Synthetic oligonucleotide
ggcagcgtc

SEQ ID NO: 2095 - DNA, 9 bp, Artificial Sequence
  Synthetic oligonucleotide
agcagtgtc

SEQ ID NO: 2096 - DNA, 9 bp, Artificial Sequence
  Synthetic oligonucleotide
agcagcatc

SEQ ID NO: 2097 - DNA, 9 bp, Artificial Sequence
  Synthetic oligonucleotide
agcagtgtc

SEQ ID NO: 2098 - DNA, 9 bp, Artificial Sequence
  Synthetic oligonucleotide
agcagagtc

SEQ ID NO: 2099 - DNA, 9 bp, Artificial Sequence
  Synthetic oligonucleotide
agtagcgtc

SEQ ID NO: 2100 - DNA, 9 bp, Artificial Sequence
  Synthetic oligonucleotide
agcagcctc

SEQ ID NO: 2101 - DNA, 9 bp, Artificial Sequence
  Synthetic oligonucleotide
agcagtgtc

SEQ ID NO: 2102 - DNA, 9 bp, Artificial Sequence
  Synthetic oligonucleotide
agcagcgtt

SEQ ID NO: 2103 - DNA, 9 bp, Artificial Sequence
  Synthetic oligonucleotide
agcagcgac

SEQ ID NO: 2104 - DNA, 9 bp, Artificial Sequence
  Synthetic oligonucleotide
agcagagtc

SEQ ID NO: 2105 - DNA, 9 bp, Artificial Sequence
  Synthetic oligonucleotide
ggcagcgtc

SEQ ID NO: 2106 - DNA, 9 bp, Artificial Sequence
  Synthetic oligonucleotide
agcagggtc

SEQ ID NO: 2107 - DNA, 9 bp, Artificial Sequence
  Synthetic oligonucleotide
agcagcatc

SEQ ID NO: 2108 - DNA, 9 bp, Artificial Sequence
  Synthetic oligonucleotide
agcagtgtc

SEQ ID NO: 2109 - DNA, 9 bp, Artificial Sequence
  Synthetic oligonucleotide
agcagggtc

SEQ ID NO: 2110 - DNA, 9 bp, Artificial Sequence
  Synthetic oligonucleotide
agcagagtc

SEQ ID NO: 2111 - DNA, 9 bp, Artificial Sequence
  Synthetic oligonucleotide
agcagcgtg

SEQ ID NO: 2112 - DNA, 9 bp, Artificial Sequence
  Synthetic oligonucleotide
agcagcgtg

SEQ ID NO: 2113 - DNA, 9 bp, Artificial Sequence
  Synthetic oligonucleotide
agcagcatc

SEQ ID NO: 2114 - DNA, 9 bp, Artificial Sequence
  Synthetic oligonucleotide
agcagcctc

SEQ ID NO: 2115 - DNA, 9 bp, Artificial Sequence
  Synthetic oligonucleotide
agcagcttc

SEQ ID NO: 2116 - DNA, 9 bp, Artificial Sequence
  Synthetic oligonucleotide
atcagcgtc

SEQ ID NO: 2117 - DNA, 9 bp, Artificial Sequence
  Synthetic oligonucleotide
agcagcatc

SEQ ID NO: 2118 - DNA, 9 bp, Artificial Sequence
  Synthetic oligonucleotide
agcagcatc

SEQ ID NO: 2119 - DNA, 9 bp, Artificial Sequence
  Synthetic oligonucleotide
tgcagcgtc

SEQ ID NO: 2120 - DNA, 9 bp, Artificial Sequence
  Synthetic oligonucleotide
agcagcttc

SEQ ID NO: 2121 - DNA, 9 bp, Artificial Sequence
  Synthetic oligonucleotide
agcagcctc

SEQ ID NO: 2122 - DNA, 9 bp, Artificial Sequence
  Synthetic oligonucleotide
agcagcgcc

SEQ ID NO: 2123 - DNA, 9 bp, Artificial Sequence
  Synthetic oligonucleotide
agcagggtc

SEQ ID NO: 2124 - DNA, 9 bp, Artificial Sequence
  Synthetic oligonucleotide
agcagcctc

SEQ ID NO: 2125 - DNA, 9 bp, Artificial Sequence
  Synthetic oligonucleotide
ggcagcgtc

SEQ ID NO: 2126 - DNA, 9 bp, Artificial Sequence
  Synthetic oligonucleotide
agcagagtc

SEQ ID NO: 2127 - DNA, 9 bp, Artificial Sequence
  Synthetic oligonucleotide
agcagcgac

SEQ ID NO: 2128 - DNA, 9 bp, Artificial Sequence
  Synthetic oligonucleotide
agcagtgtc

SEQ ID NO: 2129 - DNA, 9 bp, Artificial Sequence
  Synthetic oligonucleotide
agcagggtc

SEQ ID NO: 2130 - DNA, 9 bp, Artificial Sequence
  Synthetic oligonucleotide
agcagcggc

SEQ ID NO: 2131 - DNA, 9 bp, Artificial Sequence
  Synthetic oligonucleotide
tgcagcgtc

SEQ ID NO: 2132 - DNA, 9 bp, Artificial Sequence
  Synthetic oligonucleotide
agaagcgtc

SEQ ID NO: 2133 - DNA, 9 bp, Artificial Sequence
  Synthetic oligonucleotide
agcagggtc

SEQ ID NO: 2134 - DNA, 9 bp, Artificial Sequence
  Synthetic oligonucleotide
agcagcatc

SEQ ID NO: 2135 - DNA, 9 bp, Artificial Sequence
  Synthetic oligonucleotide
agtagcgtc

SEQ ID NO: 2136 - DNA, 9 bp, Artificial Sequence
  Synthetic oligonucleotide
agcagggtc

SEQ ID NO: 2137 - DNA, 9 bp, Artificial Sequence
  Synthetic oligonucleotide
agcagggtc

SEQ ID NO: 2138 - DNA, 9 bp, Artificial Sequence
  Synthetic oligonucleotide
agcagggtc

SEQ ID NO: 2139 - DNA, 9 bp, Artificial Sequence
  Synthetic oligonucleotide
agcaacctc

SEQ ID NO: 2140 - DNA, 9 bp, Artificial Sequence
  Synthetic oligonucleotide
agcaacgtg

SEQ ID NO: 2141 - DNA, 9 bp, Artificial Sequence
  Synthetic oligonucleotide
atcagggtc

SEQ ID NO: 2142 - DNA, 9 bp, Artificial Sequence
  Synthetic oligonucleotide
agcaaagtc

SEQ ID NO: 2143 - DNA, 9 bp, Artificial Sequence
  Synthetic oligonucleotide
agcagtgta

SEQ ID NO: 2144 - DNA, 9 bp, Artificial Sequence
  Synthetic oligonucleotide
agcagagta

SEQ ID NO: 2145 - DNA, 9 bp, Artificial Sequence
  Synthetic oligonucleotide
agcagcctg

SEQ ID NO: 2146 - DNA, 9 bp, Artificial Sequence
  Synthetic oligonucleotide
agcaacctc

SEQ ID NO: 2147 - DNA, 9 bp, Artificial Sequence
  Synthetic oligonucleotide
aacagcttc

SEQ ID NO: 2148 - DNA, 9 bp, Artificial Sequence
  Synthetic oligonucleotide
agtagtgtc

SEQ ID NO: 2149 - DNA, 9 bp, Artificial Sequence
  Synthetic oligonucleotide
atcagggtc

SEQ ID NO: 2150 - DNA, 9 bp, Artificial Sequence
  Synthetic oligonucleotide
ggcagggtc

SEQ ID NO: 2151 - DNA, 9 bp, Artificial Sequence
  Synthetic oligonucleotide
agctgggtc

SEQ ID NO: 2152 - DNA, 9 bp, Artificial Sequence
  Synthetic oligonucleotide
agctgggtc

SEQ ID NO: 2153 - DNA, 9 bp, Artificial Sequence
  Synthetic oligonucleotide
agcagctcc

SEQ ID NO: 2154 - DNA, 9 bp, Artificial Sequence
  Synthetic oligonucleotide
agcaacatc

SEQ ID NO: 2155 - DNA, 9 bp, Artificial Sequence
  Synthetic oligonucleotide
aacagcttc

SEQ ID NO: 2156 - DNA, 9 bp, Artificial Sequence
  Synthetic oligonucleotide
atcagcgcc

SEQ ID NO: 2157 - DNA, 9 bp, Artificial Sequence
  Synthetic oligonucleotide
agcaggggc

SEQ ID NO: 2158 - DNA, 9 bp, Artificial Sequence
  Synthetic oligonucleotide
agcatggtc

SEQ ID NO: 2159 - DNA, 9 bp, Artificial Sequence
  Synthetic oligonucleotide
ggcagcgtg

SEQ ID NO: 2160 - DNA, 9 bp, Artificial Sequence
  Synthetic oligonucleotide
agcagagcc

SEQ ID NO: 2161 - DNA, 9 bp, Artificial Sequence
  Synthetic oligonucleotide
agcaccgtg

SEQ ID NO: 2162 - DNA, 9 bp, Artificial Sequence
  Synthetic oligonucleotide
cccagcgtc

SEQ ID NO: 2163 - DNA, 9 bp, Artificial Sequence
  Synthetic oligonucleotide
aggagcgtg

SEQ ID NO: 2164 - DNA, 9 bp, Artificial Sequence
  Synthetic oligonucleotide
agccgagtc

SEQ ID NO: 2165 - DNA, 9 bp, Artificial Sequence
  Synthetic oligonucleotide
agtagagtc

SEQ ID NO: 2166 - DNA, 9 bp, Artificial Sequence
  Synthetic oligonucleotide
accagggtc

SEQ ID NO: 2167 - DNA, 9 bp, Artificial Sequence
  Synthetic oligonucleotide
tgcagggtc

SEQ ID NO: 2168 - DNA, 9 bp, Artificial Sequence
  Synthetic oligonucleotide
agcagcggg

SEQ ID NO: 2169 - DNA, 9 bp, Artificial Sequence
  Synthetic oligonucleotide
tgcagcgcc

SEQ ID NO: 2170 - DNA, 9 bp, Artificial Sequence
  Synthetic oligonucleotide
agtagagtc

SEQ ID NO: 2171 - DNA, 9 bp, Artificial Sequence
  Synthetic oligonucleotide
tgcagcgcc

SEQ ID NO: 2172 - DNA, 9 bp, Artificial Sequence
  Synthetic oligonucleotide
agtagggtc

SEQ ID NO: 2173 - DNA, 9 bp, Artificial Sequence
  Synthetic oligonucleotide
tgcagcgcc

SEQ ID NO: 2174 - DNA, 9 bp, Artificial Sequence
  Synthetic oligonucleotide
tgcagcgcc

SEQ ID NO: 2175 - DNA, 9 bp, Artificial Sequence
  Synthetic oligonucleotide
tgcagcgcc

SEQ ID NO: 2176 - DNA, 9 bp, Artificial Sequence
  Synthetic oligonucleotide
tgcagcgcc

SEQ ID NO: 2177 - DNA, 9 bp, Artificial Sequence
  Synthetic oligonucleotide
tgcagcgcc

SEQ ID NO: 2178 - DNA, 9 bp, Artificial Sequence
  Synthetic oligonucleotide
tgcagcgcc

SEQ ID NO: 2179 - DNA, 9 bp, Artificial Sequence
  Synthetic oligonucleotide
agcagggta

SEQ ID NO: 2180 - DNA, 9 bp, Artificial Sequence
  Synthetic oligonucleotide
agcagcggg

SEQ ID NO: 2181 - DNA, 9 bp, Artificial Sequence
  Synthetic oligonucleotide
agcaggttc

SEQ ID NO: 2182 - DNA, 9 bp, Artificial Sequence
  Synthetic oligonucleotide
ggcatcgtc

SEQ ID NO: 2183 - DNA, 9 bp, Artificial Sequence
  Synthetic oligonucleotide
aatagcgtc

SEQ ID NO: 2184 - DNA, 9 bp, Artificial Sequence
  Synthetic oligonucleotide
agcagcatg

SEQ ID NO: 2185 - DNA, 9 bp, Artificial Sequence
  Synthetic oligonucleotide
agcagcctg

SEQ ID NO: 2186 - DNA, 9 bp, Artificial Sequence
  Synthetic oligonucleotide
ggcagcgtg

SEQ ID NO: 2187 - DNA, 9 bp, Artificial Sequence
  Synthetic oligonucleotide
agcagagtt

SEQ ID NO: 2188 - DNA, 9 bp, Artificial Sequence
  Synthetic oligonucleotide
aacagagtc

SEQ ID NO: 2189 - DNA, 9 bp, Artificial Sequence
  Synthetic oligonucleotide
aacagcggc

SEQ ID NO: 2190 - DNA, 9 bp, Artificial Sequence
  Synthetic oligonucleotide
agcagggtg

SEQ ID NO: 2191 - DNA, 9 bp, Artificial Sequence
  Synthetic oligonucleotide
agctgcatc

SEQ ID NO: 2192 - DNA, 9 bp, Artificial Sequence
  Synthetic oligonucleotide
ggcagggtc

SEQ ID NO: 2193 - DNA, 9 bp, Artificial Sequence
  Synthetic oligonucleotide
agcagcttt

SEQ ID NO: 2194 - DNA, 9 bp, Artificial Sequence
  Synthetic oligonucleotide
agcagggcc

SEQ ID NO: 2195 - DNA, 9 bp, Artificial Sequence
  Synthetic oligonucleotide
agcagggcc

SEQ ID NO: 2196 - DNA, 9 bp, Artificial Sequence
  Synthetic oligonucleotide
ggcagcgtt

SEQ ID NO: 2197 - DNA, 9 bp, Artificial Sequence
  Synthetic oligonucleotide
aacagagtc

SEQ ID NO: 2198 - DNA, 9 bp, Artificial Sequence
  Synthetic oligonucleotide
agcagggcc

SEQ ID NO: 2199 - DNA, 9 bp, Artificial Sequence
  Synthetic oligonucleotide
gggagcgtc

SEQ ID NO: 2200 - DNA, 9 bp, Artificial Sequence
  Synthetic oligonucleotide
atcagtgtc

SEQ ID NO: 2201 - DNA, 9 bp, Artificial Sequence
  Synthetic oligonucleotide
agcggcttc

SEQ ID NO: 2202 - DNA, 9 bp, Artificial Sequence
  Synthetic oligonucleotide
agcaatgtc

SEQ ID NO: 2203 - DNA, 9 bp, Artificial Sequence
  Synthetic oligonucleotide
agcaaagtc

SEQ ID NO: 2204 - DNA, 9 bp, Artificial Sequence
  Synthetic oligonucleotide
agcaatgtc

SEQ ID NO: 2205 - DNA, 9 bp, Artificial Sequence
  Synthetic oligonucleotide
agcagggtg

SEQ ID NO: 2206 - DNA, 9 bp, Artificial Sequence
  Synthetic oligonucleotide
accagcctc

SEQ ID NO: 2207 - DNA, 9 bp, Artificial Sequence
  Synthetic oligonucleotide
agaagcggc

SEQ ID NO: 2208 - DNA, 9 bp, Artificial Sequence
  Synthetic oligonucleotide
agcagtgtg

SEQ ID NO: 2209 - DNA, 9 bp, Artificial Sequence
  Synthetic oligonucleotide
agcaatgtc

SEQ ID NO: 2210 - DNA, 9 bp, Artificial Sequence
  Synthetic oligonucleotide
agcagggtg

SEQ ID NO: 2211 - DNA, 9 bp, Artificial Sequence
  Synthetic oligonucleotide
agcagcatg

SEQ ID NO: 2212 - DNA, 9 bp, Artificial Sequence
  Synthetic oligonucleotide
agcagcttt

SEQ ID NO: 2213 - DNA, 9 bp, Artificial Sequence
  Synthetic oligonucleotide
agcaaggtc

SEQ ID NO: 2214 - DNA, 9 bp, Artificial Sequence
  Synthetic oligonucleotide
agcagcctg

SEQ ID NO: 2215 - DNA, 9 bp, Artificial Sequence
  Synthetic oligonucleotide
agcagtggc

SEQ ID NO: 2216 - DNA, 9 bp, Artificial Sequence
  Synthetic oligonucleotide
aacagcgtg

SEQ ID NO: 2217 - DNA, 9 bp, Artificial Sequence
  Synthetic oligonucleotide
agcatcctc

SEQ ID NO: 2218 - DNA, 9 bp, Artificial Sequence
  Synthetic oligonucleotide
agcagagcc

SEQ ID NO: 2219 - DNA, 9 bp, Artificial Sequence
  Synthetic oligonucleotide
agcagccgc

SEQ ID NO: 2220 - DNA, 9 bp, Artificial Sequence
  Synthetic oligonucleotide
agcagcgag

SEQ ID NO: 2221 - DNA, 9 bp, Artificial Sequence
  Synthetic oligonucleotide
agccgggtc

SEQ ID NO: 2222 - DNA, 9 bp, Artificial Sequence
  Synthetic oligonucleotide
agcctcgtc

SEQ ID NO: 2223 - DNA, 9 bp, Artificial Sequence
  Synthetic oligonucleotide
aggagagtc

SEQ ID NO: 2224 - DNA, 9 bp, Artificial Sequence
  Synthetic oligonucleotide
agcaatgtc

SEQ ID NO: 2225 - DNA, 9 bp, Artificial Sequence
  Synthetic oligonucleotide
agcatcggc

SEQ ID NO: 2226 - DNA, 9 bp, Artificial Sequence
  Synthetic oligonucleotide
agcatcttc

SEQ ID NO: 2227 - DNA, 9 bp, Artificial Sequence
  Synthetic oligonucleotide
ggcagcgtg

SEQ ID NO: 2228 - DNA, 9 bp, Artificial Sequence
  Synthetic oligonucleotide
agcagggta

SEQ ID NO: 2229 - DNA, 9 bp, Artificial Sequence
  Synthetic oligonucleotide
aacagagtc

SEQ ID NO: 2230 - DNA, 9 bp, Artificial Sequence
  Synthetic oligonucleotide
agcacagtc

SEQ ID NO: 2231 - DNA, 9 bp, Artificial Sequence
  Synthetic oligonucleotide
attagcgtc

SEQ ID NO: 2232 - DNA, 9 bp, Artificial Sequence
  Synthetic oligonucleotide
aacagagtc

SEQ ID NO: 2233 - DNA, 9 bp, Artificial Sequence
  Synthetic oligonucleotide
agcagcctg

SEQ ID NO: 2234 - DNA, 9 bp, Artificial Sequence
  Synthetic oligonucleotide
aacaccgtc

SEQ ID NO: 2235 - DNA, 9 bp, Artificial Sequence
  Synthetic oligonucleotide
agcagcgga

SEQ ID NO: 2236 - DNA, 9 bp, Artificial Sequence
  Synthetic oligonucleotide
ggcagcgtg

SEQ ID NO: 2237 - DNA, 9 bp, Artificial Sequence
  Synthetic oligonucleotide
aacaccgtc

SEQ ID NO: 2238 - DNA, 9 bp, Artificial Sequence
  Synthetic oligonucleotide
agcagcgat

SEQ ID NO: 2239 - DNA, 9 bp, Artificial Sequence
  Synthetic oligonucleotide
agcagggtg

SEQ ID NO: 2240 - DNA, 9 bp, Artificial Sequence
  Synthetic oligonucleotide
agctgggtc

SEQ ID NO: 2241 - DNA, 9 bp, Artificial Sequence
  Synthetic oligonucleotide
agcagctcc

SEQ ID NO: 2242 - DNA, 9 bp, Artificial Sequence
  Synthetic oligonucleotide
agcaatgtc

SEQ ID NO: 2243 - DNA, 9 bp, Artificial Sequence
  Synthetic oligonucleotide
agcacagtc

SEQ ID NO: 2244 - DNA, 9 bp, Artificial Sequence
  Synthetic oligonucleotide
agcagcgga

SEQ ID NO: 2245 - DNA, 9 bp, Artificial Sequence
  Synthetic oligonucleotide
agcagcttt

SEQ ID NO: 2246 - DNA, 9 bp, Artificial Sequence
  Synthetic oligonucleotide
agcagcgat

SEQ ID NO: 2247 - DNA, 9 bp, Artificial Sequence
  Synthetic oligonucleotide
agcagcagc

SEQ ID NO: 2248 - DNA, 9 bp, Artificial Sequence
  Synthetic oligonucleotide
aggagcggc

SEQ ID NO: 2249 - DNA, 9 bp, Artificial Sequence
  Synthetic oligonucleotide
agcacggtc

SEQ ID NO: 2250 - DNA, 9 bp, Artificial Sequence
  Synthetic oligonucleotide
agctgggtc

SEQ ID NO: 2251 - DNA, 9 bp, Artificial Sequence
  Synthetic oligonucleotide
agctgagtc

SEQ ID NO: 2252 - DNA, 9 bp, Artificial Sequence
  Synthetic oligonucleotide
agtagggtc

SEQ ID NO: 2253 - DNA, 9 bp, Artificial Sequence
  Synthetic oligonucleotide
agtagagtc

SEQ ID NO: 2254 - DNA, 9 bp, Artificial Sequence
  Synthetic oligonucleotide
aggagagtc

SEQ ID NO: 2255 - DNA, 9 bp, Artificial Sequence
  Synthetic oligonucleotide
agcgccgtc

SEQ ID NO: 2256 - DNA, 9 bp, Artificial Sequence
  Synthetic oligonucleotide
agctgtgtc

SEQ ID NO: 2257 - DNA, 9 bp, Artificial Sequence
  Synthetic oligonucleotide
agctgcctc

SEQ ID NO: 2258 - DNA, 9 bp, Artificial Sequence
  Synthetic oligonucleotide
agcagcctg

SEQ ID NO: 2259 - DNA, 9 bp, Artificial Sequence
  Synthetic oligonucleotide
agcagcctg

SEQ ID NO: 2260 - DNA, 9 bp, Artificial Sequence
  Synthetic oligonucleotide
ggcagagtc

SEQ ID NO: 2261 - DNA, 9 bp, Artificial Sequence
  Synthetic oligonucleotide
agcattgtc

SEQ ID NO: 2262 - DNA, 9 bp, Artificial Sequence
  Synthetic oligonucleotide
agcagggtg

SEQ ID NO: 2263 - DNA, 9 bp, Artificial Sequence
  Synthetic oligonucleotide
ggcagggtc

SEQ ID NO: 2264 - DNA, 9 bp, Artificial Sequence
  Synthetic oligonucleotide
agtagagtc

SEQ ID NO: 2265 - DNA, 9 bp, Artificial Sequence
  Synthetic oligonucleotide
agcagggcc

SEQ ID NO: 2266 - DNA, 9 bp, Artificial Sequence
  Synthetic oligonucleotide
agcaaagtc

SEQ ID NO: 2267 - DNA, 9 bp, Artificial Sequence
  Synthetic oligonucleotide
agcagtgcc

SEQ ID NO: 2268 - DNA, 9 bp, Artificial Sequence
  Synthetic oligonucleotide
ggcagggtc

SEQ ID NO: 2269 - DNA, 9 bp, Artificial Sequence
  Synthetic oligonucleotide
agctgggtc

SEQ ID NO: 2270 - DNA, 9 bp, Artificial Sequence
  Synthetic oligonucleotide
agcagcttt

SEQ ID NO: 2271 - DNA, 9 bp, Artificial Sequence
  Synthetic oligonucleotide
atcatcgtc

SEQ ID NO: 2272 - DNA, 9 bp, Artificial Sequence
  Synthetic oligonucleotide
agccgcgtg

SEQ ID NO: 2273 - DNA, 9 bp, Artificial Sequence
  Synthetic oligonucleotide
agcagggtg

SEQ ID NO: 2274 - DNA, 9 bp, Artificial Sequence
  Synthetic oligonucleotide
agcatggtc

SEQ ID NO: 2275 - DNA, 9 bp, Artificial Sequence
  Synthetic oligonucleotide
atcagagtc

SEQ ID NO: 2276 - DNA, 9 bp, Artificial Sequence
  Synthetic oligonucleotide
agcagtggc

SEQ ID NO: 2277 - DNA, 9 bp, Artificial Sequence
  Synthetic oligonucleotide
aggagtgtc

SEQ ID NO: 2278 - DNA, 9 bp, Artificial Sequence
  Synthetic oligonucleotide
tgcagggtc

SEQ ID NO: 2279 - DNA, 9 bp, Artificial Sequence
  Synthetic oligonucleotide
agcaggttc

SEQ ID NO: 2280 - DNA, 9 bp, Artificial Sequence
  Synthetic oligonucleotide
agcagcgga

SEQ ID NO: 2281 - DNA, 9 bp, Artificial Sequence
  Synthetic oligonucleotide
agcagggtg

SEQ ID NO: 2282 - DNA, 9 bp, Artificial Sequence
  Synthetic oligonucleotide
agcaacctc

SEQ ID NO: 2283 - DNA, 9 bp, Artificial Sequence
  Synthetic oligonucleotide
agcagggtg

SEQ ID NO: 2284 - DNA, 9 bp, Artificial Sequence
  Synthetic oligonucleotide
agcaacctc

SEQ ID NO: 2285 - DNA, 9 bp, Artificial Sequence
  Synthetic oligonucleotide
tgcagggtc

SEQ ID NO: 2286 - DNA, 9 bp, Artificial Sequence
  Synthetic oligonucleotide
agcaggttc

SEQ ID NO: 2287 - DNA, 9 bp, Artificial Sequence
  Synthetic oligonucleotide
agcaatgtc

SEQ ID NO: 2288 - DNA, 9 bp, Artificial Sequence
  Synthetic oligonucleotide
agcacggtc

SEQ ID NO: 2289 - DNA, 9 bp, Artificial Sequence
  Synthetic oligonucleotide
agcagcgct

SEQ ID NO: 2290 - DNA, 9 bp, Artificial Sequence
  Synthetic oligonucleotide
agcagggac

SEQ ID NO: 2291 - DNA, 9 bp, Artificial Sequence
  Synthetic oligonucleotide
agcagccac

SEQ ID NO: 2292 - DNA, 9 bp, Artificial Sequence
  Synthetic oligonucleotide
agtagagtc

SEQ ID NO: 2293 - DNA, 9 bp, Artificial Sequence
  Synthetic oligonucleotide
agcctcgtc

SEQ ID NO: 2294 - DNA, 9 bp, Artificial Sequence
  Synthetic oligonucleotide
ggcagcggc

SEQ ID NO: 2295 - DNA, 9 bp, Artificial Sequence
  Synthetic oligonucleotide
agcagagtt

SEQ ID NO: 2296 - DNA, 9 bp, Artificial Sequence
  Synthetic oligonucleotide
agcatcttc

SEQ ID NO: 2297 - DNA, 9 bp, Artificial Sequence
  Synthetic oligonucleotide
agcaacatc

SEQ ID NO: 2298 - DNA, 9 bp, Artificial Sequence
  Synthetic oligonucleotide
agcacagtc

SEQ ID NO: 2299 - DNA, 9 bp, Artificial Sequence
  Synthetic oligonucleotide
aggagtttc

SEQ ID NO: 2300 - DNA, 9 bp, Artificial Sequence
  Synthetic oligonucleotide
ggcagcagc

SEQ ID NO: 2301 - DNA, 9 bp, Artificial Sequence
  Synthetic oligonucleotide
agcaggttg

SEQ ID NO: 2302 - DNA, 9 bp, Artificial Sequence
  Synthetic oligonucleotide
aacagtgcc

SEQ ID NO: 2303 - DNA, 9 bp, Artificial Sequence
  Synthetic oligonucleotide
tggagcgtg

SEQ ID NO: 2304 - DNA, 9 bp, Artificial Sequence
  Synthetic oligonucleotide
tggagcgtg

SEQ ID NO: 2305 - DNA, 9 bp, Artificial Sequence
  Synthetic oligonucleotide
agctgaggc

SEQ ID NO: 2306 - DNA, 9 bp, Artificial Sequence
  Synthetic oligonucleotide
tgcagggtg

SEQ ID NO: 2307 - DNA, 9 bp, Artificial Sequence
  Synthetic oligonucleotide
aacagagtg

SEQ ID NO: 2308 - DNA, 9 bp, Artificial Sequence
  Synthetic oligonucleotide
agcaactta

SEQ ID NO: 2309 - DNA, 9 bp, Artificial Sequence
  Synthetic oligonucleotide
agcacaatc

SEQ ID NO: 2310 - DNA, 9 bp, Artificial Sequence
  Synthetic oligonucleotide
tggagggtc

SEQ ID NO: 2311 - DNA, 9 bp, Artificial Sequence
  Synthetic oligonucleotide
agccgtgtg

SEQ ID NO: 2312 - DNA, 9 bp, Artificial Sequence
  Synthetic oligonucleotide
tgctgcttc

SEQ ID NO: 2313 - DNA, 9 bp, Artificial Sequence
  Synthetic oligonucleotide
aacagagta

SEQ ID NO: 2314 - DNA, 9 bp, Artificial Sequence
  Synthetic oligonucleotide
accaacttc

SEQ ID NO: 2315 - DNA, 9 bp, Artificial Sequence
  Synthetic oligonucleotide
aggagagtg

SEQ ID NO: 2316 - DNA, 9 bp, Artificial Sequence
  Synthetic oligonucleotide
ggcagggtg

SEQ ID NO: 2317 - DNA, 9 bp, Artificial Sequence
  Synthetic oligonucleotide
ggcagggtg

SEQ ID NO: 2318 - DNA, 9 bp, Artificial Sequence
  Synthetic oligonucleotide
agcagggct

SEQ ID NO: 2319 - DNA, 9 bp, Artificial Sequence
  Synthetic oligonucleotide
tacagtgtc

SEQ ID NO: 2320 - DNA, 9 bp, Artificial Sequence
  Synthetic oligonucleotide
atcaccttc

SEQ ID NO: 2321 - DNA, 9 bp, Artificial Sequence
  Synthetic oligonucleotide
ttcagtgtc

SEQ ID NO: 2322 - DNA, 9 bp, Artificial Sequence
  Synthetic oligonucleotide
agcagctca

SEQ ID NO: 2323 - DNA, 9 bp, Artificial Sequence
  Synthetic oligonucleotide
aggagagta

SEQ ID NO: 2324 - DNA, 9 bp, Artificial Sequence
  Synthetic oligonucleotide
acctgggtc

SEQ ID NO: 2325 - DNA, 9 bp, Artificial Sequence
  Synthetic oligonucleotide
atcagtgtg

SEQ ID NO: 2326 - DNA, 9 bp, Artificial Sequence
  Synthetic oligonucleotide
tggagggtc

SEQ ID NO: 2327 - DNA, 9 bp, Artificial Sequence
  Synthetic oligonucleotide
ggcagggtg

SEQ ID NO: 2328 - DNA, 9 bp, Artificial Sequence
  Synthetic oligonucleotide
aggagagtg

SEQ ID NO: 2329 - DNA, 9 bp, Artificial Sequence
  Synthetic oligonucleotide
agcagtgca

SEQ ID NO: 2330 - DNA, 9 bp, Artificial Sequence
  Synthetic oligonucleotide
agcaggttg

SEQ ID NO: 2331 - DNA, 9 bp, Artificial Sequence
  Synthetic oligonucleotide
aggagagtg

SEQ ID NO: 2332 - DNA, 9 bp, Artificial Sequence
  Synthetic oligonucleotide
agcagccgt

SEQ ID NO: 2333 - DNA, 9 bp, Artificial Sequence
  Synthetic oligonucleotide
agcagggca

SEQ ID NO: 2334 - DNA, 9 bp, Artificial Sequence
  Synthetic oligonucleotide
gccagcctc

SEQ ID NO: 2335 - DNA, 9 bp, Artificial Sequence
  Synthetic oligonucleotide
agcagggct

SEQ ID NO: 2336 - DNA, 9 bp, Artificial Sequence
  Synthetic oligonucleotide
agtagcaac

SEQ ID NO: 2337 - DNA, 9 bp, Artificial Sequence
  Synthetic oligonucleotide
aacagcgga

SEQ ID NO: 2338 - DNA, 9 bp, Artificial Sequence
  Synthetic oligonucleotide
aggaccatc

SEQ ID NO: 2339 - DNA, 9 bp, Artificial Sequence
  Synthetic oligonucleotide
aggaccatc

SEQ ID NO: 2340 - DNA, 9 bp, Artificial Sequence
  Synthetic oligonucleotide
aggaccatc

SEQ ID NO: 2341 - DNA, 9 bp, Artificial Sequence
  Synthetic oligonucleotide
aggaccatc

SEQ ID NO: 2342 - DNA, 9 bp, Artificial Sequence
  Synthetic oligonucleotide
agcaggtta

SEQ ID NO: 2343 - DNA, 9 bp, Artificial Sequence
  Synthetic oligonucleotide
tgcagggtg

SEQ ID NO: 2344 - DNA, 9 bp, Artificial Sequence
  Synthetic oligonucleotide
agaagggta

SEQ ID NO: 2345 - DNA, 9 bp, Artificial Sequence
  Synthetic oligonucleotide
agatgcggc

SEQ ID NO: 2346 - DNA, 9 bp, Artificial Sequence
  Synthetic oligonucleotide
aatagggtc

SEQ ID NO: 2347 - DNA, 9 bp, Artificial Sequence
  Synthetic oligonucleotide
agcagtgaa

SEQ ID NO: 2348 - DNA, 9 bp, Artificial Sequence
  Synthetic oligonucleotide
agaaacgtg

SEQ ID NO: 2349 - DNA, 9 bp, Artificial Sequence
  Synthetic oligonucleotide
aacagggac

SEQ ID NO: 2350 - DNA, 9 bp, Artificial Sequence
  Synthetic oligonucleotide
agcaaggac

SEQ ID NO: 2351 - DNA, 9 bp, Artificial Sequence
  Synthetic oligonucleotide
agcagatgc

SEQ ID NO: 2352 - DNA, 9 bp, Artificial Sequence
  Synthetic oligonucleotide
agcagctgt

SEQ ID NO: 2353 - DNA, 9 bp, Artificial Sequence
  Synthetic oligonucleotide
agaagggtt

SEQ ID NO: 2354 - DNA, 9 bp, Artificial Sequence
  Synthetic oligonucleotide
aacagagtg

SEQ ID NO: 2355 - DNA, 9 bp, Artificial Sequence
  Synthetic oligonucleotide
ggcagtggc

SEQ ID NO: 2356 - DNA, 9 bp, Artificial Sequence
  Synthetic oligonucleotide
agcaccgag

SEQ ID NO: 2357 - DNA, 9 bp, Artificial Sequence
  Synthetic oligonucleotide
atcagcatg

SEQ ID NO: 2358 - DNA, 9 bp, Artificial Sequence
  Synthetic oligonucleotide
agctgtgtg

SEQ ID NO: 2359 - DNA, 9 bp, Artificial Sequence
  Synthetic oligonucleotide
tgcagggtg

SEQ ID NO: 2360 - DNA, 9 bp, Artificial Sequence
  Synthetic oligonucleotide
tgcagggtg

SEQ ID NO: 2361 - DNA, 9 bp, Artificial Sequence
  Synthetic oligonucleotide
aggaggttc

SEQ ID NO: 2362 - DNA, 9 bp, Artificial Sequence
  Synthetic oligonucleotide
aggaatgtc

SEQ ID NO: 2363 - DNA, 9 bp, Artificial Sequence
  Synthetic oligonucleotide
agtagctgc

SEQ ID NO: 2364 - DNA, 9 bp, Artificial Sequence
  Synthetic oligonucleotide
agaagggtg

SEQ ID NO: 2365 - DNA, 9 bp, Artificial Sequence
  Synthetic oligonucleotide
agtagctgc

SEQ ID NO: 2366 - DNA, 9 bp, Artificial Sequence
  Synthetic oligonucleotide
agtagctgc

SEQ ID NO: 2367 - DNA, 9 bp, Artificial Sequence
  Synthetic oligonucleotide
agtagctgc

SEQ ID NO: 2368 - DNA, 9 bp, Artificial Sequence
  Synthetic oligonucleotide
agtagctgc

SEQ ID NO: 2369 - DNA, 9 bp, Artificial Sequence
  Synthetic oligonucleotide
agtagctgc

SEQ ID NO: 2370 - DNA, 9 bp, Artificial Sequence
  Synthetic oligonucleotide
agtagctgc

SEQ ID NO: 2371 - DNA, 9 bp, Artificial Sequence
  Synthetic oligonucleotide
agtagctgc

SEQ ID NO: 2372 - DNA, 9 bp, Artificial Sequence
  Synthetic oligonucleotide
agtagaggc

SEQ ID NO: 2373 - DNA, 9 bp, Artificial Sequence
  Synthetic oligonucleotide
ggcagcagc

SEQ ID NO: 2374 - DNA, 9 bp, Artificial Sequence
  Synthetic oligonucleotide
agcagcaca

SEQ ID NO: 2375 - DNA, 9 bp, Artificial Sequence
  Synthetic oligonucleotide
tgcatcgta

SEQ ID NO: 2376 - DNA, 9 bp, Artificial Sequence
  Synthetic oligonucleotide
ggcagggtg

SEQ ID NO: 2377 - DNA, 9 bp, Artificial Sequence
  Synthetic oligonucleotide
agcagctga

SEQ ID NO: 2378 - DNA, 9 bp, Artificial Sequence
  Synthetic oligonucleotide
tggagcgtg

SEQ ID NO: 2379 - DNA, 9 bp, Artificial Sequence
  Synthetic oligonucleotide
tccagggtc

SEQ ID NO: 2380 - DNA, 9 bp, Artificial Sequence
  Synthetic oligonucleotide
tgcagcgaa

SEQ ID NO: 2381 - DNA, 9 bp, Artificial Sequence
  Synthetic oligonucleotide
agcaggttg

SEQ ID NO: 2382 - DNA, 9 bp, Artificial Sequence
  Synthetic oligonucleotide
agctgaggc

SEQ ID NO: 2383 - DNA, 9 bp, Artificial Sequence
  Synthetic oligonucleotide
aacagtggc

SEQ ID NO: 2384 - DNA, 9 bp, Artificial Sequence
  Synthetic oligonucleotide
ggcagtgcc

SEQ ID NO: 2385 - DNA, 9 bp, Artificial Sequence
  Synthetic oligonucleotide
ggcagtgcc

SEQ ID NO: 2386 - DNA, 9 bp, Artificial Sequence
  Synthetic oligonucleotide
ggcagtgcc

SEQ ID NO: 2387 - DNA, 9 bp, Artificial Sequence
  Synthetic oligonucleotide
aggagagta

SEQ ID NO: 2388 - DNA, 9 bp, Artificial Sequence
  Synthetic oligonucleotide
cgcagcatt

SEQ ID NO: 2389 - DNA, 9 bp, Artificial Sequence
  Synthetic oligonucleotide
ggaagtgtc

SEQ ID NO: 2390 - DNA, 9 bp, Artificial Sequence
  Synthetic oligonucleotide
agctgcata

SEQ ID NO: 2391 - DNA, 9 bp, Artificial Sequence
  Synthetic oligonucleotide
actagggtc

SEQ ID NO: 2392 - DNA, 9 bp, Artificial Sequence
  Synthetic oligonucleotide
agctgtgtg

SEQ ID NO: 2393 - DNA, 9 bp, Artificial Sequence
  Synthetic oligonucleotide
accactgtc

SEQ ID NO: 2394 - DNA, 9 bp, Artificial Sequence
  Synthetic oligonucleotide
ggtagcttc

SEQ ID NO: 2395 - DNA, 9 bp, Artificial Sequence
  Synthetic oligonucleotide
agcagggct

SEQ ID NO: 2396 - DNA, 9 bp, Artificial Sequence
  Synthetic oligonucleotide
agctgtgtg

SEQ ID NO: 2397 - DNA, 9 bp, Artificial Sequence
  Synthetic oligonucleotide
tgaagagtc

SEQ ID NO: 2398 - DNA, 9 bp, Artificial Sequence
  Synthetic oligonucleotide
tgaagagtc

SEQ ID NO: 2399 - DNA, 9 bp, Artificial Sequence
  Synthetic oligonucleotide
acgagggtc

SEQ ID NO: 2400 - DNA, 9 bp, Artificial Sequence
  Synthetic oligonucleotide
agaagcggt

SEQ ID NO: 2401 - DNA, 9 bp, Artificial Sequence
  Synthetic oligonucleotide
ggcagagtt

SEQ ID NO: 2402 - DNA, 9 bp, Artificial Sequence
  Synthetic oligonucleotide
agcagttac

SEQ ID NO: 2403 - DNA, 9 bp, Artificial Sequence
  Synthetic oligonucleotide
tgcagtgtg

SEQ ID NO: 2404 - DNA, 9 bp, Artificial Sequence
  Synthetic oligonucleotide
ctctgcgtc

SEQ ID NO: 2405 - DNA, 9 bp, Artificial Sequence
  Synthetic oligonucleotide
aggagagtg

SEQ ID NO: 2406 - DNA, 9 bp, Artificial Sequence
  Synthetic oligonucleotide
aggagagtg

SEQ ID NO: 2407 - DNA, 9 bp, Artificial Sequence
  Synthetic oligonucleotide
aatagggtc

SEQ ID NO: 2408 - DNA, 9 bp, Artificial Sequence
  Synthetic oligonucleotide
agcagcgtc

SEQ ID NO: 2409 - DNA, 9 bp, Artificial Sequence
  Synthetic oligonucleotide
agcagcgtc

SEQ ID NO: 2410 - DNA, 9 bp, Artificial Sequence
  Synthetic oligonucleotide
agcagcgtc

SEQ ID NO: 2411 - DNA, 9 bp, Artificial Sequence
  Synthetic oligonucleotide
agcagcgtc

SEQ ID NO: 2412 - DNA, 9 bp, Artificial Sequence
  Synthetic oligonucleotide
agcagcgtc

SEQ ID NO: 2413 - DNA, 9 bp, Artificial Sequence
  Synthetic oligonucleotide
agcagcgtc

SEQ ID NO: 2414 - DNA, 9 bp, Artificial Sequence
  Synthetic oligonucleotide
agcagcgtc

SEQ ID NO: 2415 - DNA, 9 bp, Artificial Sequence
  Synthetic oligonucleotide
agcagcgtc

SEQ ID NO: 2416 - DNA, 9 bp, Artificial Sequence
  Synthetic oligonucleotide
agcagcgtc

SEQ ID NO: 2417 - DNA, 9 bp, Artificial Sequence
  Synthetic oligonucleotide
agcagcgtc

SEQ ID NO: 2418 - DNA, 9 bp, Artificial Sequence
  Synthetic oligonucleotide
agcagcgtc

SEQ ID NO: 2419 - DNA, 9 bp, Artificial Sequence
  Synthetic oligonucleotide
agcagcgtc

SEQ ID NO: 2420 - DNA, 9 bp, Artificial Sequence
  Synthetic oligonucleotide
agcagcgtc

SEQ ID NO: 2421 - DNA, 9 bp, Artificial Sequence
  Synthetic oligonucleotide
agcagcgtc

SEQ ID NO: 2422 - DNA, 9 bp, Artificial Sequence
  Synthetic oligonucleotide
agcagcgtc

SEQ ID NO: 2423 - DNA, 9 bp, Artificial Sequence
  Synthetic oligonucleotide
agcagcgtc

SEQ ID NO: 2424 - DNA, 9 bp, Artificial Sequence
  Synthetic oligonucleotide
agcagcgtc

SEQ ID NO: 2425 - DNA, 9 bp, Artificial Sequence
  Synthetic oligonucleotide
agcagcgtc

SEQ ID NO: 2426 - DNA, 9 bp, Artificial Sequence
  Synthetic oligonucleotide
agcagcgtc

SEQ ID NO: 2427 - DNA, 9 bp, Artificial Sequence
  Synthetic oligonucleotide
agcagcgtc

SEQ ID NO: 2428 - DNA, 9 bp, Artificial Sequence
  Synthetic oligonucleotide
agcagcgtc

SEQ ID NO: 2429 - DNA, 9 bp, Artificial Sequence
  Synthetic oligonucleotide
agcagcgtc

SEQ ID NO: 2430 - DNA, 9 bp, Artificial Sequence
  Synthetic oligonucleotide
agcagcgtc

SEQ ID NO: 2431 - DNA, 9 bp, Artificial Sequence
  Synthetic oligonucleotide
agcagcgtc

SEQ ID NO: 2432 - DNA, 9 bp, Artificial Sequence
  Synthetic oligonucleotide
agcagcgtc

SEQ ID NO: 2433 - DNA, 9 bp, Artificial Sequence
  Synthetic oligonucleotide
agcagcgtc

SEQ ID NO: 2434 - DNA, 9 bp, Artificial Sequence
  Synthetic oligonucleotide
agccgcgtc

SEQ ID NO: 2435 - DNA, 9 bp, Artificial Sequence
  Synthetic oligonucleotide
agcagtgtc

SEQ ID NO: 2436 - DNA, 9 bp, Artificial Sequence
  Synthetic oligonucleotide
agcagtgtc

SEQ ID NO: 2437 - DNA, 9 bp, Artificial Sequence
  Synthetic oligonucleotide
agcatcgtc

SEQ ID NO: 2438 - DNA, 9 bp, Artificial Sequence
  Synthetic oligonucleotide
agcagcggc

SEQ ID NO: 2439 - DNA, 9 bp, Artificial Sequence
  Synthetic oligonucleotide
agcaacgtc

SEQ ID NO: 2440 - DNA, 9 bp, Artificial Sequence
  Synthetic oligonucleotide
agcagtgtc

SEQ ID NO: 2441 - DNA, 9 bp, Artificial Sequence
  Synthetic oligonucleotide
agcagcggc

SEQ ID NO: 2442 - DNA, 9 bp, Artificial Sequence
  Synthetic oligonucleotide
agcaacgtc

SEQ ID NO: 2443 - DNA, 9 bp, Artificial Sequence
  Synthetic oligonucleotide
agcaacgtc

SEQ ID NO: 2444 - DNA, 9 bp, Artificial Sequence
  Synthetic oligonucleotide
agtagcgtc

SEQ ID NO: 2445 - DNA, 9 bp, Artificial Sequence
  Synthetic oligonucleotide
agcaacgtc

SEQ ID NO: 2446 - DNA, 9 bp, Artificial Sequence
  Synthetic oligonucleotide
agcagcgtt

SEQ ID NO: 2447 - DNA, 9 bp, Artificial Sequence
  Synthetic oligonucleotide
agcagtgtc

SEQ ID NO: 2448 - DNA, 9 bp, Artificial Sequence
  Synthetic oligonucleotide
agcaacgtc

SEQ ID NO: 2449 - DNA, 9 bp, Artificial Sequence
  Synthetic oligonucleotide
agcaacgtc

SEQ ID NO: 2450 - DNA, 9 bp, Artificial Sequence
  Synthetic oligonucleotide
ggcagcgtc

SEQ ID NO: 2451 - DNA, 9 bp, Artificial Sequence
  Synthetic oligonucleotide
agcaacgtc

SEQ ID NO: 2452 - DNA, 9 bp, Artificial Sequence
  Synthetic oligonucleotide
agcagagtc

SEQ ID NO: 2453 - DNA, 9 bp, Artificial Sequence
  Synthetic oligonucleotide
agcagcggc

SEQ ID NO: 2454 - DNA, 9 bp, Artificial Sequence
  Synthetic oligonucleotide
agcagtgtc

SEQ ID NO: 2455 - DNA, 9 bp, Artificial Sequence
  Synthetic oligonucleotide
agcatcgtc

SEQ ID NO: 2456 - DNA, 9 bp, Artificial Sequence
  Synthetic oligonucleotide
agcaacgtc

SEQ ID NO: 2457 - DNA, 9 bp, Artificial Sequence
  Synthetic oligonucleotide
agcaacgtc

SEQ ID NO: 2458 - DNA, 9 bp, Artificial Sequence
  Synthetic oligonucleotide
agcagggtc

SEQ ID NO: 2459 - DNA, 9 bp, Artificial Sequence
  Synthetic oligonucleotide
accagcgtc

SEQ ID NO: 2460 - DNA, 9 bp, Artificial Sequence
  Synthetic oligonucleotide
agcaacgtc

SEQ ID NO: 2461 - DNA, 9 bp, Artificial Sequence
  Synthetic oligonucleotide
agcagcatc

SEQ ID NO: 2462 - DNA, 9 bp, Artificial Sequence
  Synthetic oligonucleotide
agcagcggc

SEQ ID NO: 2463 - DNA, 9 bp, Artificial Sequence
  Synthetic oligonucleotide
agcagtgtc

SEQ ID NO: 2464 - DNA, 9 bp, Artificial Sequence
  Synthetic oligonucleotide
agcaacgtc

SEQ ID NO: 2465 - DNA, 9 bp, Artificial Sequence
  Synthetic oligonucleotide
agcagcggc

SEQ ID NO: 2466 - DNA, 9 bp, Artificial Sequence
  Synthetic oligonucleotide
agcagcggc

SEQ ID NO: 2467 - DNA, 9 bp, Artificial Sequence
  Synthetic oligonucleotide
agcagtgtc

SEQ ID NO: 2468 - DNA, 9 bp, Artificial Sequence
  Synthetic oligonucleotide
agcaacgtc

SEQ ID NO: 2469 - DNA, 9 bp, Artificial Sequence
  Synthetic oligonucleotide
agcagagtc

SEQ ID NO: 2470 - DNA, 9 bp, Artificial Sequence
  Synthetic oligonucleotide
agcagtgtc

SEQ ID NO: 2471 - DNA, 9 bp, Artificial Sequence
  Synthetic oligonucleotide
agcagtgtc

SEQ ID NO: 2472 - DNA, 9 bp, Artificial Sequence
  Synthetic oligonucleotide
tgcagcgtc

SEQ ID NO: 2473 - DNA, 9 bp, Artificial Sequence
  Synthetic oligonucleotide
ggcagcgtc

SEQ ID NO: 2474 - DNA, 9 bp, Artificial Sequence
  Synthetic oligonucleotide
agcagcgtg

SEQ ID NO: 2475 - DNA, 9 bp, Artificial Sequence
  Synthetic oligonucleotide
agcagcggc

SEQ ID NO: 2476 - DNA, 9 bp, Artificial Sequence
  Synthetic oligonucleotide
agcagtgtc

SEQ ID NO: 2477 - DNA, 9 bp, Artificial Sequence
  Synthetic oligonucleotide
agcagtgtc

SEQ ID NO: 2478 - DNA, 9 bp, Artificial Sequence
  Synthetic oligonucleotide
accagcgtc

SEQ ID NO: 2479 - DNA, 9 bp, Artificial Sequence
  Synthetic oligonucleotide
agcaacgtc

SEQ ID NO: 2480 - DNA, 9 bp, Artificial Sequence
  Synthetic oligonucleotide
agcaacgtc

SEQ ID NO: 2481 - DNA, 9 bp, Artificial Sequence
  Synthetic oligonucleotide
agcaacgtc

SEQ ID NO: 2482 - DNA, 9 bp, Artificial Sequence
  Synthetic oligonucleotide
agcaacgtc

SEQ ID NO: 2483 - DNA, 9 bp, Artificial Sequence
  Synthetic oligonucleotide
agcagtgtc

SEQ ID NO: 2484 - DNA, 9 bp, Artificial Sequence
  Synthetic oligonucleotide
agcagcggc

SEQ ID NO: 2485 - DNA, 9 bp, Artificial Sequence
  Synthetic oligonucleotide
agcagtgtc

SEQ ID NO: 2486 - DNA, 9 bp, Artificial Sequence
  Synthetic oligonucleotide
agcagcggc

SEQ ID NO: 2487 - DNA, 9 bp, Artificial Sequence
  Synthetic oligonucleotide
agcaacgtc

SEQ ID NO: 2488 - DNA, 9 bp, Artificial Sequence
  Synthetic oligonucleotide
agcagagtc

SEQ ID NO: 2489 - DNA, 9 bp, Artificial Sequence
  Synthetic oligonucleotide
agcagtgtc

SEQ ID NO: 2490 - DNA, 9 bp, Artificial Sequence
  Synthetic oligonucleotide
agcaccgtc

SEQ ID NO: 2491 - DNA, 9 bp, Artificial Sequence
  Synthetic oligonucleotide
accagcgtc

SEQ ID NO: 2492 - DNA, 9 bp, Artificial Sequence
  Synthetic oligonucleotide
agcaacgtc

SEQ ID NO: 2493 - DNA, 9 bp, Artificial Sequence
  Synthetic oligonucleotide
agcaacgtc

SEQ ID NO: 2494 - DNA, 9 bp, Artificial Sequence
  Synthetic oligonucleotide
agcaacgtc

SEQ ID NO: 2495 - DNA, 9 bp, Artificial Sequence
  Synthetic oligonucleotide
agcagggtc

SEQ ID NO: 2496 - DNA, 9 bp, Artificial Sequence
  Synthetic oligonucleotide
agcagtgtc

SEQ ID NO: 2497 - DNA, 9 bp, Artificial Sequence
  Synthetic oligonucleotide
agcaacgtc

SEQ ID NO: 2498 - DNA, 9 bp, Artificial Sequence
  Synthetic oligonucleotide
agcaacgtc

SEQ ID NO: 2499 - DNA, 9 bp, Artificial Sequence
  Synthetic oligonucleotide
agcagtgtc

SEQ ID NO: 2500 - DNA, 9 bp, Artificial Sequence
  Synthetic oligonucleotide
agcagcggc

SEQ ID NO: 2501 - DNA, 9 bp, Artificial Sequence
  Synthetic oligonucleotide
agcaacgtc

SEQ ID NO: 2502 - DNA, 9 bp, Artificial Sequence
  Synthetic oligonucleotide
agcaacgtc

SEQ ID NO: 2503 - DNA, 9 bp, Artificial Sequence
  Synthetic oligonucleotide
agcagcttc

SEQ ID NO: 2504 - DNA, 9 bp, Artificial Sequence
  Synthetic oligonucleotide
agcagtgtc

SEQ ID NO: 2505 - DNA, 9 bp, Artificial Sequence
  Synthetic oligonucleotide
agcatcgtc

SEQ ID NO: 2506 - DNA, 9 bp, Artificial Sequence
  Synthetic oligonucleotide
agcagcggc

SEQ ID NO: 2507 - DNA, 9 bp, Artificial Sequence
  Synthetic oligonucleotide
agcatcgtc

SEQ ID NO: 2508 - DNA, 9 bp, Artificial Sequence
  Synthetic oligonucleotide
agcagcgtt

SEQ ID NO: 2509 - DNA, 9 bp, Artificial Sequence
  Synthetic oligonucleotide
agcagcggc

SEQ ID NO: 2510 - DNA, 9 bp, Artificial Sequence
  Synthetic oligonucleotide
aacagcgtc

SEQ ID NO: 2511 - DNA, 9 bp, Artificial Sequence
  Synthetic oligonucleotide
agcatcgtc

SEQ ID NO: 2512 - DNA, 9 bp, Artificial Sequence
  Synthetic oligonucleotide
agcatcgtc

SEQ ID NO: 2513 - DNA, 9 bp, Artificial Sequence
  Synthetic oligonucleotide
agcatcgtc

SEQ ID NO: 2514 - DNA, 9 bp, Artificial Sequence
  Synthetic oligonucleotide
agcatcgtc

SEQ ID NO: 2515 - DNA, 9 bp, Artificial Sequence
  Synthetic oligonucleotide
agcagcatc

SEQ ID NO: 2516 - DNA, 9 bp, Artificial Sequence
  Synthetic oligonucleotide
agcaacgtc

SEQ ID NO: 2517 - DNA, 9 bp, Artificial Sequence
  Synthetic oligonucleotide
agcaccgtc

SEQ ID NO: 2518 - DNA, 9 bp, Artificial Sequence
  Synthetic oligonucleotide
agcaacgtc

SEQ ID NO: 2519 - DNA, 9 bp, Artificial Sequence
  Synthetic oligonucleotide
aacagcgtc

SEQ ID NO: 2520 - DNA, 9 bp, Artificial Sequence
  Synthetic oligonucleotide
agcaacgtc

SEQ ID NO: 2521 - DNA, 9 bp, Artificial Sequence
  Synthetic oligonucleotide
agcaacgtc

SEQ ID NO: 2522 - DNA, 9 bp, Artificial Sequence
  Synthetic oligonucleotide
agcaccgtc

SEQ ID NO: 2523 - DNA, 9 bp, Artificial Sequence
  Synthetic oligonucleotide
agcaccgtc

SEQ ID NO: 2524 - DNA, 9 bp, Artificial Sequence
  Synthetic oligonucleotide
agcagggtc

SEQ ID NO: 2525 - DNA, 9 bp, Artificial Sequence
  Synthetic oligonucleotide
agcaacgtc

SEQ ID NO: 2526 - DNA, 9 bp, Artificial Sequence
  Synthetic oligonucleotide
agcaacgtc

SEQ ID NO: 2527 - DNA, 9 bp, Artificial Sequence
  Synthetic oligonucleotide
agcagcttc

SEQ ID NO: 2528 - DNA, 9 bp, Artificial Sequence
  Synthetic oligonucleotide
ggcagcgtc

SEQ ID NO: 2529 - DNA, 9 bp, Artificial Sequence
  Synthetic oligonucleotide
agcaacgtc

SEQ ID NO: 2530 - DNA, 9 bp, Artificial Sequence
  Synthetic oligonucleotide
agcagcggc

SEQ ID NO: 2531 - DNA, 9 bp, Artificial Sequence
  Synthetic oligonucleotide
agcagcggc

SEQ ID NO: 2532 - DNA, 9 bp, Artificial Sequence
  Synthetic oligonucleotide
agcagtgtc

SEQ ID NO: 2533 - DNA, 9 bp, Artificial Sequence
  Synthetic oligonucleotide
agcagtgtc

SEQ ID NO: 2534 - DNA, 9 bp, Artificial Sequence
  Synthetic oligonucleotide
agcaacgtc

SEQ ID NO: 2535 - DNA, 9 bp, Artificial Sequence
  Synthetic oligonucleotide
agcaacgtc

SEQ ID NO: 2536 - DNA, 9 bp, Artificial Sequence
  Synthetic oligonucleotide
agcagtgtc

SEQ ID NO: 2537 - DNA, 9 bp, Artificial Sequence
  Synthetic oligonucleotide
agcaacgtc

SEQ ID NO: 2538 - DNA, 9 bp, Artificial Sequence
  Synthetic oligonucleotide
agcagcgtg

SEQ ID NO: 2539 - DNA, 9 bp, Artificial Sequence
  Synthetic oligonucleotide
agcagggtc

SEQ ID NO: 2540 - DNA, 9 bp, Artificial Sequence
  Synthetic oligonucleotide
agcaccgtc

SEQ ID NO: 2541 - DNA, 9 bp, Artificial Sequence
  Synthetic oligonucleotide
agcaccgtc

SEQ ID NO: 2542 - DNA, 9 bp, Artificial Sequence
  Synthetic oligonucleotide
atcagcgtc

SEQ ID NO: 2543 - DNA, 9 bp, Artificial Sequence
  Synthetic oligonucleotide
agcatcgtc

SEQ ID NO: 2544 - DNA, 9 bp, Artificial Sequence
  Synthetic oligonucleotide
agcaacgtc

SEQ ID NO: 2545 - DNA, 9 bp, Artificial Sequence
  Synthetic oligonucleotide
agcagcgac

SEQ ID NO: 2546 - DNA, 9 bp, Artificial Sequence
  Synthetic oligonucleotide
agcaccgtc

SEQ ID NO: 2547 - DNA, 9 bp, Artificial Sequence
  Synthetic oligonucleotide
agcagtgtc

SEQ ID NO: 2548 - DNA, 9 bp, Artificial Sequence
  Synthetic oligonucleotide
agcagtgtc

SEQ ID NO: 2549 - DNA, 9 bp, Artificial Sequence
  Synthetic oligonucleotide
agcagcggc

SEQ ID NO: 2550 - DNA, 9 bp, Artificial Sequence
  Synthetic oligonucleotide
agcagggtc

SEQ ID NO: 2551 - DNA, 9 bp, Artificial Sequence
  Synthetic oligonucleotide
agcaccggc

SEQ ID NO: 2552 - DNA, 9 bp, Artificial Sequence
  Synthetic oligonucleotide
agcagagtg

SEQ ID NO: 2553 - DNA, 9 bp, Artificial Sequence
  Synthetic oligonucleotide
agcaaggtc

SEQ ID NO: 2554 - DNA, 9 bp, Artificial Sequence
  Synthetic oligonucleotide
agcatggtc

SEQ ID NO: 2555 - DNA, 9 bp, Artificial Sequence
  Synthetic oligonucleotide
atcagtgtc

SEQ ID NO: 2556 - DNA, 9 bp, Artificial Sequence
  Synthetic oligonucleotide
agcatggtc

SEQ ID NO: 2557 - DNA, 9 bp, Artificial Sequence
  Synthetic oligonucleotide
agcaatgtc

SEQ ID NO: 2558 - DNA, 9 bp, Artificial Sequence
  Synthetic oligonucleotide
agcattgtc

SEQ ID NO: 2559 - DNA, 9 bp, Artificial Sequence
  Synthetic oligonucleotide
agcattgtc

SEQ ID NO: 2560 - DNA, 9 bp, Artificial Sequence
  Synthetic oligonucleotide
agcaaggtc

SEQ ID NO: 2561 - DNA, 9 bp, Artificial Sequence
  Synthetic oligonucleotide
agcagggta

SEQ ID NO: 2562 - DNA, 9 bp, Artificial Sequence
  Synthetic oligonucleotide
agcagcgca

SEQ ID NO: 2563 - DNA, 9 bp, Artificial Sequence
  Synthetic oligonucleotide
agcagcatt

SEQ ID NO: 2564 - DNA, 9 bp, Artificial Sequence
  Synthetic oligonucleotide
agcatggtc

SEQ ID NO: 2565 - DNA, 9 bp, Artificial Sequence
  Synthetic oligonucleotide
agctgcatc

SEQ ID NO: 2566 - DNA, 9 bp, Artificial Sequence
  Synthetic oligonucleotide
agaaacgtc

SEQ ID NO: 2567 - DNA, 9 bp, Artificial Sequence
  Synthetic oligonucleotide
tgcagtgtc

SEQ ID NO: 2568 - DNA, 9 bp, Artificial Sequence
  Synthetic oligonucleotide
aacaacgtc

SEQ ID NO: 2569 - DNA, 9 bp, Artificial Sequence
  Synthetic oligonucleotide
agcaaggtc

SEQ ID NO: 2570 - DNA, 9 bp, Artificial Sequence
  Synthetic oligonucleotide
agcagtgtg

SEQ ID NO: 2571 - DNA, 9 bp, Artificial Sequence
  Synthetic oligonucleotide
agtagtgtc

SEQ ID NO: 2572 - DNA, 9 bp, Artificial Sequence
  Synthetic oligonucleotide
agcagggtt

SEQ ID NO: 2573 - DNA, 9 bp, Artificial Sequence
  Synthetic oligonucleotide
agcatggtc

SEQ ID NO: 2574 - DNA, 9 bp, Artificial Sequence
  Synthetic oligonucleotide
agcagcatt

SEQ ID NO: 2575 - DNA, 9 bp, Artificial Sequence
  Synthetic oligonucleotide
agcaccgta

SEQ ID NO: 2576 - DNA, 9 bp, Artificial Sequence
  Synthetic oligonucleotide
agctgtgtc

SEQ ID NO: 2577 - DNA, 9 bp, Artificial Sequence
  Synthetic oligonucleotide
agccgggtc

SEQ ID NO: 2578 - DNA, 9 bp, Artificial Sequence
  Synthetic oligonucleotide
aacagggtc

SEQ ID NO: 2579 - DNA, 9 bp, Artificial Sequence
  Synthetic oligonucleotide
agcactgtc

SEQ ID NO: 2580 - DNA, 9 bp, Artificial Sequence
  Synthetic oligonucleotide
agcaacgtg

SEQ ID NO: 2581 - DNA, 9 bp, Artificial Sequence
  Synthetic oligonucleotide
agcagggtg

SEQ ID NO: 2582 - DNA, 9 bp, Artificial Sequence
  Synthetic oligonucleotide
agcacagtc

SEQ ID NO: 2583 - DNA, 9 bp, Artificial Sequence
  Synthetic oligonucleotide
agcattgtc

SEQ ID NO: 2584 - DNA, 9 bp, Artificial Sequence
  Synthetic oligonucleotide
atcagagtc

SEQ ID NO: 2585 - DNA, 9 bp, Artificial Sequence
  Synthetic oligonucleotide
agcaacctc

SEQ ID NO: 2586 - DNA, 9 bp, Artificial Sequence
  Synthetic oligonucleotide
agcggagtc

SEQ ID NO: 2587 - DNA, 9 bp, Artificial Sequence
  Synthetic oligonucleotide
agcatggtc

SEQ ID NO: 2588 - DNA, 9 bp, Artificial Sequence
  Synthetic oligonucleotide
tgcagtgtc

SEQ ID NO: 2589 - DNA, 9 bp, Artificial Sequence
  Synthetic oligonucleotide
ggcaccgtc

SEQ ID NO: 2590 - DNA, 9 bp, Artificial Sequence
  Synthetic oligonucleotide
agcaaagtc

SEQ ID NO: 2591 - DNA, 9 bp, Artificial Sequence
  Synthetic oligonucleotide
agcagcatt

SEQ ID NO: 2592 - DNA, 9 bp, Artificial Sequence
  Synthetic oligonucleotide
agcagcatt

SEQ ID NO: 2593 - DNA, 9 bp, Artificial Sequence
  Synthetic oligonucleotide
agcagtgac

SEQ ID NO: 2594 - DNA, 9 bp, Artificial Sequence
  Synthetic oligonucleotide
agcagtgac

SEQ ID NO: 2595 - DNA, 9 bp, Artificial Sequence
  Synthetic oligonucleotide
agcaatgtc

SEQ ID NO: 2596 - DNA, 9 bp, Artificial Sequence
  Synthetic oligonucleotide
agcaacatc

SEQ ID NO: 2597 - DNA, 9 bp, Artificial Sequence
  Synthetic oligonucleotide
tgcagggtc

SEQ ID NO: 2598 - DNA, 9 bp, Artificial Sequence
  Synthetic oligonucleotide
agcaacggc

SEQ ID NO: 2599 - DNA, 9 bp, Artificial Sequence
  Synthetic oligonucleotide
agcatggtc

SEQ ID NO: 2600 - DNA, 9 bp, Artificial Sequence
  Synthetic oligonucleotide
ggcagtgtc

SEQ ID NO: 2601 - DNA, 9 bp, Artificial Sequence
  Synthetic oligonucleotide
agcaccggc

SEQ ID NO: 2602 - DNA, 9 bp, Artificial Sequence
  Synthetic oligonucleotide
aacagtgtc

SEQ ID NO: 2603 - DNA, 9 bp, Artificial Sequence
  Synthetic oligonucleotide
agcaaagtc

SEQ ID NO: 2604 - DNA, 9 bp, Artificial Sequence
  Synthetic oligonucleotide
agcaatgtc

SEQ ID NO: 2605 - DNA, 9 bp, Artificial Sequence
  Synthetic oligonucleotide
agcagtctc

SEQ ID NO: 2606 - DNA, 9 bp, Artificial Sequence
  Synthetic oligonucleotide
agcaaagtc

SEQ ID NO: 2607 - DNA, 9 bp, Artificial Sequence
  Synthetic oligonucleotide
agcagcagc

SEQ ID NO: 2608 - DNA, 9 bp, Artificial Sequence
  Synthetic oligonucleotide
aacatcgtc

SEQ ID NO: 2609 - DNA, 9 bp, Artificial Sequence
  Synthetic oligonucleotide
agcaacatc

SEQ ID NO: 2610 - DNA, 9 bp, Artificial Sequence
  Synthetic oligonucleotide
agccccgtc

SEQ ID NO: 2611 - DNA, 9 bp, Artificial Sequence
  Synthetic oligonucleotide
agcagcggt

SEQ ID NO: 2612 - DNA, 9 bp, Artificial Sequence
  Synthetic oligonucleotide
agcaaggtc

SEQ ID NO: 2613 - DNA, 9 bp, Artificial Sequence
  Synthetic oligonucleotide
aacagagtc

SEQ ID NO: 2614 - DNA, 9 bp, Artificial Sequence
  Synthetic oligonucleotide
ggcagcgtg

SEQ ID NO: 2615 - DNA, 9 bp, Artificial Sequence
  Synthetic oligonucleotide
agcatagtc

SEQ ID NO: 2616 - DNA, 9 bp, Artificial Sequence
  Synthetic oligonucleotide
agccgtgtc

SEQ ID NO: 2617 - DNA, 9 bp, Artificial Sequence
  Synthetic oligonucleotide
agcatggtc

SEQ ID NO: 2618 - DNA, 9 bp, Artificial Sequence
  Synthetic oligonucleotide
agtagtgtc

SEQ ID NO: 2619 - DNA, 9 bp, Artificial Sequence
  Synthetic oligonucleotide
agcagcatt

SEQ ID NO: 2620 - DNA, 9 bp, Artificial Sequence
  Synthetic oligonucleotide
agcagcatt

SEQ ID NO: 2621 - DNA, 9 bp, Artificial Sequence
  Synthetic oligonucleotide
cgcagtgtc

SEQ ID NO: 2622 - DNA, 9 bp, Artificial Sequence
  Synthetic oligonucleotide
agcagggtg

SEQ ID NO: 2623 - DNA, 9 bp, Artificial Sequence
  Synthetic oligonucleotide
agcagggta

SEQ ID NO: 2624 - DNA, 9 bp, Artificial Sequence
  Synthetic oligonucleotide
agcatagtc

SEQ ID NO: 2625 - DNA, 9 bp, Artificial Sequence
  Synthetic oligonucleotide
agcatggtc

SEQ ID NO: 2626 - DNA, 9 bp, Artificial Sequence
  Synthetic oligonucleotide
tccagcgtc

SEQ ID NO: 2627 - DNA, 9 bp, Artificial Sequence
  Synthetic oligonucleotide
agcactgtc

SEQ ID NO: 2628 - DNA, 9 bp, Artificial Sequence
  Synthetic oligonucleotide
agcatagtc

SEQ ID NO: 2629 - DNA, 9 bp, Artificial Sequence
  Synthetic oligonucleotide
agcagtgtg

SEQ ID NO: 2630 - DNA, 9 bp, Artificial Sequence
  Synthetic oligonucleotide
agcaacggc

SEQ ID NO: 2631 - DNA, 9 bp, Artificial Sequence
  Synthetic oligonucleotide
agccgggtc

SEQ ID NO: 2632 - DNA, 9 bp, Artificial Sequence
  Synthetic oligonucleotide
agcaatgtc

SEQ ID NO: 2633 - DNA, 9 bp, Artificial Sequence
  Synthetic oligonucleotide
agcaacgtg

SEQ ID NO: 2634 - DNA, 9 bp, Artificial Sequence
  Synthetic oligonucleotide
agcacggtc

SEQ ID NO: 2635 - DNA, 9 bp, Artificial Sequence
  Synthetic oligonucleotide
agcatggtc

SEQ ID NO: 2636 - DNA, 9 bp, Artificial Sequence
  Synthetic oligonucleotide
agcagggta

SEQ ID NO: 2637 - DNA, 9 bp, Artificial Sequence
  Synthetic oligonucleotide
agcggtgtc

SEQ ID NO: 2638 - DNA, 9 bp, Artificial Sequence
  Synthetic oligonucleotide
agcaaggtc

SEQ ID NO: 2639 - DNA, 9 bp, Artificial Sequence
  Synthetic oligonucleotide
agcaccttc

SEQ ID NO: 2640 - DNA, 9 bp, Artificial Sequence
  Synthetic oligonucleotide
agcaaagtc

SEQ ID NO: 2641 - DNA, 9 bp, Artificial Sequence
  Synthetic oligonucleotide
agcaaggtc

SEQ ID NO: 2642 - DNA, 9 bp, Artificial Sequence
  Synthetic oligonucleotide
agcagcagc

SEQ ID NO: 2643 - DNA, 9 bp, Artificial Sequence
  Synthetic oligonucleotide
agcaacctc

SEQ ID NO: 2644 - DNA, 9 bp, Artificial Sequence
  Synthetic oligonucleotide
tgcagcgac

SEQ ID NO: 2645 - DNA, 9 bp, Artificial Sequence
  Synthetic oligonucleotide
ggcagcttc

SEQ ID NO: 2646 - DNA, 9 bp, Artificial Sequence
  Synthetic oligonucleotide
aacagtgtc

SEQ ID NO: 2647 - DNA, 9 bp, Artificial Sequence
  Synthetic oligonucleotide
agcttcgtc

SEQ ID NO: 2648 - DNA, 9 bp, Artificial Sequence
  Synthetic oligonucleotide
agcagcatt

SEQ ID NO: 2649 - DNA, 9 bp, Artificial Sequence
  Synthetic oligonucleotide
agcaacgtg

SEQ ID NO: 2650 - DNA, 9 bp, Artificial Sequence
  Synthetic oligonucleotide
agcaatgtc

SEQ ID NO: 2651 - DNA, 9 bp, Artificial Sequence
  Synthetic oligonucleotide
tgcagtgtc

SEQ ID NO: 2652 - DNA, 9 bp, Artificial Sequence
  Synthetic oligonucleotide
agcaacggc

SEQ ID NO: 2653 - DNA, 9 bp, Artificial Sequence
  Synthetic oligonucleotide
agcatcggc

SEQ ID NO: 2654 - DNA, 9 bp, Artificial Sequence
  Synthetic oligonucleotide
agcatcggc

SEQ ID NO: 2655 - DNA, 9 bp, Artificial Sequence
  Synthetic oligonucleotide
agcatcggc

SEQ ID NO: 2656 - DNA, 9 bp, Artificial Sequence
  Synthetic oligonucleotide
agcaaggtc

SEQ ID NO: 2657 - DNA, 9 bp, Artificial Sequence
  Synthetic oligonucleotide
agcggagtc

SEQ ID NO: 2658 - DNA, 9 bp, Artificial Sequence
  Synthetic oligonucleotide
agcaccatc

SEQ ID NO: 2659 - DNA, 9 bp, Artificial Sequence
  Synthetic oligonucleotide
agctgcttc

SEQ ID NO: 2660 - DNA, 9 bp, Artificial Sequence
  Synthetic oligonucleotide
agcaacatc

SEQ ID NO: 2661 - DNA, 9 bp, Artificial Sequence
  Synthetic oligonucleotide
aacagtgtc

SEQ ID NO: 2662 - DNA, 9 bp, Artificial Sequence
  Synthetic oligonucleotide
agcatcgta

SEQ ID NO: 2663 - DNA, 9 bp, Artificial Sequence
  Synthetic oligonucleotide
agcatggtc

SEQ ID NO: 2664 - DNA, 9 bp, Artificial Sequence
  Synthetic oligonucleotide
aacagcttc

SEQ ID NO: 2665 - DNA, 9 bp, Artificial Sequence
  Synthetic oligonucleotide
agcaacttc

SEQ ID NO: 2666 - DNA, 9 bp, Artificial Sequence
  Synthetic oligonucleotide
agcagcatt

SEQ ID NO: 2667 - DNA, 9 bp, Artificial Sequence
  Synthetic oligonucleotide
agcagggtg

SEQ ID NO: 2668 - DNA, 9 bp, Artificial Sequence
  Synthetic oligonucleotide
agcattgtc

SEQ ID NO: 2669 - DNA, 9 bp, Artificial Sequence
  Synthetic oligonucleotide
ggcagcgtg

SEQ ID NO: 2670 - DNA, 9 bp, Artificial Sequence
  Synthetic oligonucleotide
agctgtgtc

SEQ ID NO: 2671 - DNA, 9 bp, Artificial Sequence
  Synthetic oligonucleotide
agcagcatt

SEQ ID NO: 2672 - DNA, 9 bp, Artificial Sequence
  Synthetic oligonucleotide
agcagtgtt

SEQ ID NO: 2673 - DNA, 9 bp, Artificial Sequence
  Synthetic oligonucleotide
agcacagtc

SEQ ID NO: 2674 - DNA, 9 bp, Artificial Sequence
  Synthetic oligonucleotide
ggcagcttc

SEQ ID NO: 2675 - DNA, 9 bp, Artificial Sequence
  Synthetic oligonucleotide
agcattgtc

SEQ ID NO: 2676 - DNA, 9 bp, Artificial Sequence
  Synthetic oligonucleotide
agcatggtc

SEQ ID NO: 2677 - DNA, 9 bp, Artificial Sequence
  Synthetic oligonucleotide
agcagggtg

SEQ ID NO: 2678 - DNA, 9 bp, Artificial Sequence
  Synthetic oligonucleotide
agcaacttc

SEQ ID NO: 2679 - DNA, 9 bp, Artificial Sequence
  Synthetic oligonucleotide
agcagcagc

SEQ ID NO: 2680 - DNA, 9 bp, Artificial Sequence
  Synthetic oligonucleotide
tgcagggtc

SEQ ID NO: 2681 - DNA, 9 bp, Artificial Sequence
  Synthetic oligonucleotide
tgcagcgtt

SEQ ID NO: 2682 - DNA, 9 bp, Artificial Sequence
  Synthetic oligonucleotide
agcagcata

SEQ ID NO: 2683 - DNA, 9 bp, Artificial Sequence
  Synthetic oligonucleotide
agcagtgtg

SEQ ID NO: 2684 - DNA, 9 bp, Artificial Sequence
  Synthetic oligonucleotide
aacagcatc

SEQ ID NO: 2685 - DNA, 9 bp, Artificial Sequence
  Synthetic oligonucleotide
agcagtgtg

SEQ ID NO: 2686 - DNA, 9 bp, Artificial Sequence
  Synthetic oligonucleotide
aacagagtc

SEQ ID NO: 2687 - DNA, 9 bp, Artificial Sequence
  Synthetic oligonucleotide
agcaacgtt

SEQ ID NO: 2688 - DNA, 9 bp, Artificial Sequence
  Synthetic oligonucleotide
agcaaagtc

SEQ ID NO: 2689 - DNA, 9 bp, Artificial Sequence
  Synthetic oligonucleotide
tgcatcgtc

SEQ ID NO: 2690 - DNA, 9 bp, Artificial Sequence
  Synthetic oligonucleotide
agcaaggtc

SEQ ID NO: 2691 - DNA, 9 bp, Artificial Sequence
  Synthetic oligonucleotide
ggcaccgtc

SEQ ID NO: 2692 - DNA, 9 bp, Artificial Sequence
  Synthetic oligonucleotide
agcagagta

SEQ ID NO: 2693 - DNA, 9 bp, Artificial Sequence
  Synthetic oligonucleotide
agcaaagtc

SEQ ID NO: 2694 - DNA, 9 bp, Artificial Sequence
  Synthetic oligonucleotide
agaagtgtc

SEQ ID NO: 2695 - DNA, 9 bp, Artificial Sequence
  Synthetic oligonucleotide
agcagcatt

SEQ ID NO: 2696 - DNA, 9 bp, Artificial Sequence
  Synthetic oligonucleotide
agcaaagtc

SEQ ID NO: 2697 - DNA, 9 bp, Artificial Sequence
  Synthetic oligonucleotide
agcaaagtc

SEQ ID NO: 2698 - DNA, 9 bp, Artificial Sequence
  Synthetic oligonucleotide
ggcagtgtc

SEQ ID NO: 2699 - DNA, 9 bp, Artificial Sequence
  Synthetic oligonucleotide
agcagcaac

SEQ ID NO: 2700 - DNA, 9 bp, Artificial Sequence
  Synthetic oligonucleotide
agcattgtc

SEQ ID NO: 2701 - DNA, 9 bp, Artificial Sequence
  Synthetic oligonucleotide
agcaaggtc

SEQ ID NO: 2702 - DNA, 9 bp, Artificial Sequence
  Synthetic oligonucleotide
agcatcggc

SEQ ID NO: 2703 - DNA, 9 bp, Artificial Sequence
  Synthetic oligonucleotide
agcagggtg

SEQ ID NO: 2704 - DNA, 9 bp, Artificial Sequence
  Synthetic oligonucleotide
agcagcgct

SEQ ID NO: 2705 - DNA, 9 bp, Artificial Sequence
  Synthetic oligonucleotide
agcagggtg

SEQ ID NO: 2706 - DNA, 9 bp, Artificial Sequence
  Synthetic oligonucleotide
tgcagcgtg

SEQ ID NO: 2707 - DNA, 9 bp, Artificial Sequence
  Synthetic oligonucleotide
tgcagtgtc

SEQ ID NO: 2708 - DNA, 9 bp, Artificial Sequence
  Synthetic oligonucleotide
agcagggtg

SEQ ID NO: 2709 - DNA, 9 bp, Artificial Sequence
  Synthetic oligonucleotide
aacagggtc

SEQ ID NO: 2710 - DNA, 9 bp, Artificial Sequence
  Synthetic oligonucleotide
aacagcggc

SEQ ID NO: 2711 - DNA, 9 bp, Artificial Sequence
  Synthetic oligonucleotide
agcaacgtt

SEQ ID NO: 2712 - DNA, 9 bp, Artificial Sequence
  Synthetic oligonucleotide
agcagtgtt

SEQ ID NO: 2713 - DNA, 9 bp, Artificial Sequence
  Synthetic oligonucleotide
agcaccgtg

SEQ ID NO: 2714 - DNA, 9 bp, Artificial Sequence
  Synthetic oligonucleotide
agcaacgtt

SEQ ID NO: 2715 - DNA, 9 bp, Artificial Sequence
  Synthetic oligonucleotide
agccacgtc

SEQ ID NO: 2716 - DNA, 9 bp, Artificial Sequence
  Synthetic oligonucleotide
agcagggtg

SEQ ID NO: 2717 - DNA, 9 bp, Artificial Sequence
  Synthetic oligonucleotide
tgcagcggc

SEQ ID NO: 2718 - DNA, 9 bp, Artificial Sequence
  Synthetic oligonucleotide
agcattgtc

SEQ ID NO: 2719 - DNA, 9 bp, Artificial Sequence
  Synthetic oligonucleotide
ggcaccgtc

SEQ ID NO: 2720 - DNA, 9 bp, Artificial Sequence
  Synthetic oligonucleotide
agcatggtc

SEQ ID NO: 2721 - DNA, 9 bp, Artificial Sequence
  Synthetic oligonucleotide
agcaccttc

SEQ ID NO: 2722 - DNA, 9 bp, Artificial Sequence
  Synthetic oligonucleotide
agtagtgtc

SEQ ID NO: 2723 - DNA, 9 bp, Artificial Sequence
  Synthetic oligonucleotide
agcaccatc

SEQ ID NO: 2724 - DNA, 9 bp, Artificial Sequence
  Synthetic oligonucleotide
agccacgtc

SEQ ID NO: 2725 - DNA, 9 bp, Artificial Sequence
  Synthetic oligonucleotide
agcaacatc

SEQ ID NO: 2726 - DNA, 9 bp, Artificial Sequence
  Synthetic oligonucleotide
agccgagtc

SEQ ID NO: 2727 - DNA, 9 bp, Artificial Sequence
  Synthetic oligonucleotide
accagtgtc

SEQ ID NO: 2728 - DNA, 9 bp, Artificial Sequence
  Synthetic oligonucleotide
agcaacgac

SEQ ID NO: 2729 - DNA, 9 bp, Artificial Sequence
  Synthetic oligonucleotide
agcagcatt

SEQ ID NO: 2730 - DNA, 9 bp, Artificial Sequence
  Synthetic oligonucleotide
agcagcatt

SEQ ID NO: 2731 - DNA, 9 bp, Artificial Sequence
  Synthetic oligonucleotide
cgcagtgtc

SEQ ID NO: 2732 - DNA, 9 bp, Artificial Sequence
  Synthetic oligonucleotide
tgcatcgtc

SEQ ID NO: 2733 - DNA, 9 bp, Artificial Sequence
  Synthetic oligonucleotide
agctgagtc

SEQ ID NO: 2734 - DNA, 9 bp, Artificial Sequence
  Synthetic oligonucleotide
agcaacgtg

SEQ ID NO: 2735 - DNA, 9 bp, Artificial Sequence
  Synthetic oligonucleotide
agcagtggc

SEQ ID NO: 2736 - DNA, 9 bp, Artificial Sequence
  Synthetic oligonucleotide
agcagcatt

SEQ ID NO: 2737 - DNA, 9 bp, Artificial Sequence
  Synthetic oligonucleotide
agcaccatc

SEQ ID NO: 2738 - DNA, 9 bp, Artificial Sequence
  Synthetic oligonucleotide
agcacagtc

SEQ ID NO: 2739 - DNA, 9 bp, Artificial Sequence
  Synthetic oligonucleotide
agcatggtc

SEQ ID NO: 2740 - DNA, 9 bp, Artificial Sequence
  Synthetic oligonucleotide
agcatggtc

SEQ ID NO: 2741 - DNA, 9 bp, Artificial Sequence
  Synthetic oligonucleotide
agtaacgtc

SEQ ID NO: 2742 - DNA, 9 bp, Artificial Sequence
  Synthetic oligonucleotide
agcaacttc

SEQ ID NO: 2743 - DNA, 9 bp, Artificial Sequence
  Synthetic oligonucleotide
agcagcatt

SEQ ID NO: 2744 - DNA, 9 bp, Artificial Sequence
  Synthetic oligonucleotide
agcaatgtc

SEQ ID NO: 2745 - DNA, 9 bp, Artificial Sequence
  Synthetic oligonucleotide
agcaatgtc

SEQ ID NO: 2746 - DNA, 9 bp, Artificial Sequence
  Synthetic oligonucleotide
agcagattc

SEQ ID NO: 2747 - DNA, 9 bp, Artificial Sequence
  Synthetic oligonucleotide
cacagcgtc

SEQ ID NO: 2748 - DNA, 9 bp, Artificial Sequence
  Synthetic oligonucleotide
agcagcgat

SEQ ID NO: 2749 - DNA, 9 bp, Artificial Sequence
  Synthetic oligonucleotide
agcaccgtg

SEQ ID NO: 2750 - DNA, 9 bp, Artificial Sequence
  Synthetic oligonucleotide
atcagtgtc

SEQ ID NO: 2751 - DNA, 9 bp, Artificial Sequence
  Synthetic oligonucleotide
agcaacctc

SEQ ID NO: 2752 - DNA, 9 bp, Artificial Sequence
  Synthetic oligonucleotide
agcaacttc

SEQ ID NO: 2753 - DNA, 9 bp, Artificial Sequence
  Synthetic oligonucleotide
agcaacttc

SEQ ID NO: 2754 - DNA, 9 bp, Artificial Sequence
  Synthetic oligonucleotide
agcaacgtg

SEQ ID NO: 2755 - DNA, 9 bp, Artificial Sequence
  Synthetic oligonucleotide
aacagcatc

SEQ ID NO: 2756 - DNA, 9 bp, Artificial Sequence
  Synthetic oligonucleotide
acaagcgtc

SEQ ID NO: 2757 - DNA, 9 bp, Artificial Sequence
  Synthetic oligonucleotide
tccagcgtc

SEQ ID NO: 2758 - DNA, 9 bp, Artificial Sequence
  Synthetic oligonucleotide
agcaaggtc

SEQ ID NO: 2759 - DNA, 9 bp, Artificial Sequence
  Synthetic oligonucleotide
agtagcgtt

SEQ ID NO: 2760 - DNA, 9 bp, Artificial Sequence
  Synthetic oligonucleotide
agcagtgtt

SEQ ID NO: 2761 - DNA, 9 bp, Artificial Sequence
  Synthetic oligonucleotide
agcatggtc

SEQ ID NO: 2762 - DNA, 9 bp, Artificial Sequence
  Synthetic oligonucleotide
agcagcgga

SEQ ID NO: 2763 - DNA, 9 bp, Artificial Sequence
  Synthetic oligonucleotide
agcaccgac

SEQ ID NO: 2764 - DNA, 9 bp, Artificial Sequence
  Synthetic oligonucleotide
agcagtgac

SEQ ID NO: 2765 - DNA, 9 bp, Artificial Sequence
  Synthetic oligonucleotide
agcagggtt

SEQ ID NO: 2766 - DNA, 9 bp, Artificial Sequence
  Synthetic oligonucleotide
agcagcatg

SEQ ID NO: 2767 - DNA, 9 bp, Artificial Sequence
  Synthetic oligonucleotide
atcagagtc

SEQ ID NO: 2768 - DNA, 9 bp, Artificial Sequence
  Synthetic oligonucleotide
agcagggtt

SEQ ID NO: 2769 - DNA, 9 bp, Artificial Sequence
  Synthetic oligonucleotide
agcagggtg

SEQ ID NO: 2770 - DNA, 9 bp, Artificial Sequence
  Synthetic oligonucleotide
ggcagtgtc

SEQ ID NO: 2771 - DNA, 9 bp, Artificial Sequence
  Synthetic oligonucleotide
ggcatcgtc

SEQ ID NO: 2772 - DNA, 9 bp, Artificial Sequence
  Synthetic oligonucleotide
agcaccgtg

SEQ ID NO: 2773 - DNA, 9 bp, Artificial Sequence
  Synthetic oligonucleotide
agcagagtt

SEQ ID NO: 2774 - DNA, 9 bp, Artificial Sequence
  Synthetic oligonucleotide
gacagcctc

SEQ ID NO: 2775 - DNA, 9 bp, Artificial Sequence
  Synthetic oligonucleotide
aggggggtc

SEQ ID NO: 2776 - DNA, 9 bp, Artificial Sequence
  Synthetic oligonucleotide
agcctggtc

SEQ ID NO: 2777 - DNA, 9 bp, Artificial Sequence
  Synthetic oligonucleotide
ggcagcgat

SEQ ID NO: 2778 - DNA, 9 bp, Artificial Sequence
  Synthetic oligonucleotide
aacaaggtc

SEQ ID NO: 2779 - DNA, 9 bp, Artificial Sequence
  Synthetic oligonucleotide
agctgagac

SEQ ID NO: 2780 - DNA, 9 bp, Artificial Sequence
  Synthetic oligonucleotide
agctgagac

SEQ ID NO: 2781 - DNA, 9 bp, Artificial Sequence
  Synthetic oligonucleotide
ggcagagtg

SEQ ID NO: 2782 - DNA, 9 bp, Artificial Sequence
  Synthetic oligonucleotide
agctgggtt

SEQ ID NO: 2783 - DNA, 9 bp, Artificial Sequence
  Synthetic oligonucleotide
agcaaaggc

SEQ ID NO: 2784 - DNA, 9 bp, Artificial Sequence
  Synthetic oligonucleotide
agtaacggc

SEQ ID NO: 2785 - DNA, 9 bp, Artificial Sequence
  Synthetic oligonucleotide
agcattgtt

SEQ ID NO: 2786 - DNA, 9 bp, Artificial Sequence
  Synthetic oligonucleotide
cacagcatc

SEQ ID NO: 2787 - DNA, 9 bp, Artificial Sequence
  Synthetic oligonucleotide
agccacatc

SEQ ID NO: 2788 - DNA, 9 bp, Artificial Sequence
  Synthetic oligonucleotide
agcagcaca

SEQ ID NO: 2789 - DNA, 9 bp, Artificial Sequence
  Synthetic oligonucleotide
agcattgcc

SEQ ID NO: 2790 - DNA, 9 bp, Artificial Sequence
  Synthetic oligonucleotide
agaagtgcc

SEQ ID NO: 2791 - DNA, 9 bp, Artificial Sequence
  Synthetic oligonucleotide
atcagcata

SEQ ID NO: 2792 - DNA, 9 bp, Artificial Sequence
  Synthetic oligonucleotide
agcaggtac

SEQ ID NO: 2793 - DNA, 9 bp, Artificial Sequence
  Synthetic oligonucleotide
aactacgtc

SEQ ID NO: 2794 - DNA, 9 bp, Artificial Sequence
  Synthetic oligonucleotide
agaagtgcc

SEQ ID NO: 2795 - DNA, 9 bp, Artificial Sequence
  Synthetic oligonucleotide
aggagtctc

SEQ ID NO: 2796 - DNA, 9 bp, Artificial Sequence
  Synthetic oligonucleotide
tccagcggc

SEQ ID NO: 2797 - DNA, 9 bp, Artificial Sequence
  Synthetic oligonucleotide
agctcagtc

SEQ ID NO: 2798 - DNA, 9 bp, Artificial Sequence
  Synthetic oligonucleotide
agctcagtc

SEQ ID NO: 2799 - DNA, 9 bp, Artificial Sequence
  Synthetic oligonucleotide
aacagtatc

SEQ ID NO: 2800 - DNA, 9 bp, Artificial Sequence
  Synthetic oligonucleotide
ggaagtgtc

SEQ ID NO: 2801 - DNA, 9 bp, Artificial Sequence
  Synthetic oligonucleotide
ctcagagtc

SEQ ID NO: 2802 - DNA, 9 bp, Artificial Sequence
  Synthetic oligonucleotide
aacagtgtt

SEQ ID NO: 2803 - DNA, 9 bp, Artificial Sequence
  Synthetic oligonucleotide
ctcagcttc

SEQ ID NO: 2804 - DNA, 9 bp, Artificial Sequence
  Synthetic oligonucleotide
agcagctgt

SEQ ID NO: 2805 - DNA, 9 bp, Artificial Sequence
  Synthetic oligonucleotide
agctgtgtg

SEQ ID NO: 2806 - DNA, 9 bp, Artificial Sequence
  Synthetic oligonucleotide
aggtgtgtc

SEQ ID NO: 2807 - DNA, 9 bp, Artificial Sequence
  Synthetic oligonucleotide
attagagtc

SEQ ID NO: 2808 - DNA, 9 bp, Artificial Sequence
  Synthetic oligonucleotide
agccggctc

SEQ ID NO: 2809 - DNA, 9 bp, Artificial Sequence
  Synthetic oligonucleotide
agcaccagc

SEQ ID NO: 2810 - DNA, 9 bp, Artificial Sequence
  Synthetic oligonucleotide
ttcagcgtt

SEQ ID NO: 2811 - DNA, 9 bp, Artificial Sequence
  Synthetic oligonucleotide
agctccttc

SEQ ID NO: 2812 - DNA, 9 bp, Artificial Sequence
  Synthetic oligonucleotide
aagagtgtc

SEQ ID NO: 2813 - DNA, 9 bp, Artificial Sequence
  Synthetic oligonucleotide
tgcagggta

SEQ ID NO: 2814 - DNA, 9 bp, Artificial Sequence
  Synthetic oligonucleotide
aggatcatc

SEQ ID NO: 2815 - DNA, 9 bp, Artificial Sequence
  Synthetic oligonucleotide
gtctgcgtc

SEQ ID NO: 2816 - DNA, 9 bp, Artificial Sequence
  Synthetic oligonucleotide
atgagcgac

SEQ ID NO: 2817 - DNA, 9 bp, Artificial Sequence
  Synthetic oligonucleotide
cccagggtc

SEQ ID NO: 2818 - DNA, 9 bp, Artificial Sequence
  Synthetic oligonucleotide
agtacagtc

SEQ ID NO: 2819 - DNA, 9 bp, Artificial Sequence
  Synthetic oligonucleotide
agcttcctc

SEQ ID NO: 2820 - DNA, 9 bp, Artificial Sequence
  Synthetic oligonucleotide
agaagtgcc

SEQ ID NO: 2821 - DNA, 9 bp, Artificial Sequence
  Synthetic oligonucleotide
ggcagagtg

SEQ ID NO: 2822 - DNA, 9 bp, Artificial Sequence
  Synthetic oligonucleotide
agcagttcc

SEQ ID NO: 2823 - DNA, 9 bp, Artificial Sequence
  Synthetic oligonucleotide
ggcactgtc

SEQ ID NO: 2824 - DNA, 9 bp, Artificial Sequence
  Synthetic oligonucleotide
agcaggcac

SEQ ID NO: 2825 - DNA, 9 bp, Artificial Sequence
  Synthetic oligonucleotide
agtggagtc

SEQ ID NO: 2826 - DNA, 9 bp, Artificial Sequence
  Synthetic oligonucleotide
aggacagtc

SEQ ID NO: 2827 - DNA, 9 bp, Artificial Sequence
  Synthetic oligonucleotide
agctgtgtg

SEQ ID NO: 2828 - DNA, 9 bp, Artificial Sequence
  Synthetic oligonucleotide
agcaaggtg

SEQ ID NO: 2829 - DNA, 9 bp, Artificial Sequence
  Synthetic oligonucleotide
tgctgtgtc

SEQ ID NO: 2830 - DNA, 9 bp, Artificial Sequence
  Synthetic oligonucleotide
ggcacagtc

SEQ ID NO: 2831 - DNA, 9 bp, Artificial Sequence
  Synthetic oligonucleotide
agctcagtc

SEQ ID NO: 2832 - DNA, 9 bp, Artificial Sequence
  Synthetic oligonucleotide
gtcagtgtc

SEQ ID NO: 2833 - DNA, 9 bp, Artificial Sequence
  Synthetic oligonucleotide
ggaagggtc

SEQ ID NO: 2834 - DNA, 9 bp, Artificial Sequence
  Synthetic oligonucleotide
aggagcaac

SEQ ID NO: 2835 - DNA, 9 bp, Artificial Sequence
  Synthetic oligonucleotide
agcggtttc

SEQ ID NO: 2836 - DNA, 9 bp, Artificial Sequence
  Synthetic oligonucleotide
agcagcacg

SEQ ID NO: 2837 - DNA, 9 bp, Artificial Sequence
  Synthetic oligonucleotide
agaagggtg

SEQ ID NO: 2838 - DNA, 9 bp, Artificial Sequence
  Synthetic oligonucleotide
tgctgtgtc

SEQ ID NO: 2839 - DNA, 9 bp, Artificial Sequence
  Synthetic oligonucleotide
agctcagtc

SEQ ID NO: 2840 - DNA, 9 bp, Artificial Sequence
  Synthetic oligonucleotide
agcaaggtt

SEQ ID NO: 2841 - DNA, 9 bp, Artificial Sequence
  Synthetic oligonucleotide
agctcagtc

SEQ ID NO: 2842 - DNA, 9 bp, Artificial Sequence
  Synthetic oligonucleotide
agcacggtg

SEQ ID NO: 2843 - DNA, 9 bp, Artificial Sequence
  Synthetic oligonucleotide
agcagggat

SEQ ID NO: 2844 - DNA, 9 bp, Artificial Sequence
  Synthetic oligonucleotide
atcagcttt

SEQ ID NO: 2845 - DNA, 9 bp, Artificial Sequence
  Synthetic oligonucleotide
agcacagac

SEQ ID NO: 2846 - DNA, 9 bp, Artificial Sequence
  Synthetic oligonucleotide
cccagcttc

SEQ ID NO: 2847 - DNA, 9 bp, Artificial Sequence
  Synthetic oligonucleotide
cgccccgtc

SEQ ID NO: 2848 - DNA, 9 bp, Artificial Sequence
  Synthetic oligonucleotide
agcagaggt

SEQ ID NO: 2849 - DNA, 9 bp, Artificial Sequence
  Synthetic oligonucleotide
agccacctc

SEQ ID NO: 2850 - DNA, 9 bp, Artificial Sequence
  Synthetic oligonucleotide
agccctgtc

SEQ ID NO: 2851 - DNA, 9 bp, Artificial Sequence
  Synthetic oligonucleotide
agcagcagt

SEQ ID NO: 2852 - DNA, 9 bp, Artificial Sequence
  Synthetic oligonucleotide
agccacttc

SEQ ID NO: 2853 - DNA, 9 bp, Artificial Sequence
  Synthetic oligonucleotide
aggtgcggc

SEQ ID NO: 2854 - DNA, 9 bp, Artificial Sequence
  Synthetic oligonucleotide
agctgtgtg

SEQ ID NO: 2855 - DNA, 9 bp, Artificial Sequence
  Synthetic oligonucleotide
aggcgcttc

SEQ ID NO: 2856 - DNA, 9 bp, Artificial Sequence
  Synthetic oligonucleotide
aggagtctc

SEQ ID NO: 2857 - DNA, 9 bp, Artificial Sequence
  Synthetic oligonucleotide
atcatcctc

SEQ ID NO: 2858 - DNA, 9 bp, Artificial Sequence
  Synthetic oligonucleotide
agccgggta

SEQ ID NO: 2859 - DNA, 9 bp, Artificial Sequence
  Synthetic oligonucleotide
agcaactgc

SEQ ID NO: 2860 - DNA, 9 bp, Artificial Sequence
  Synthetic oligonucleotide
ggcagcatt

SEQ ID NO: 2861 - DNA, 9 bp, Artificial Sequence
  Synthetic oligonucleotide
cacagcatc

SEQ ID NO: 2862 - DNA, 9 bp, Artificial Sequence
  Synthetic oligonucleotide
agctgagac

SEQ ID NO: 2863 - DNA, 9 bp, Artificial Sequence
  Synthetic oligonucleotide
acccgtgtc

SEQ ID NO: 2864 - DNA, 9 bp, Artificial Sequence
  Synthetic oligonucleotide
agccctgtc

SEQ ID NO: 2865 - DNA, 9 bp, Artificial Sequence
  Synthetic oligonucleotide
ggacgcgtc

SEQ ID NO: 2866 - DNA, 9 bp, Artificial Sequence
  Synthetic oligonucleotide
aggaacctc

SEQ ID NO: 2867 - DNA, 9 bp, Artificial Sequence
  Synthetic oligonucleotide
agctgtgtg

SEQ ID NO: 2868 - DNA, 9 bp, Artificial Sequence
  Synthetic oligonucleotide
cgctgcgac

SEQ ID NO: 2869 - DNA, 9 bp, Artificial Sequence
  Synthetic oligonucleotide
ggtagagtc

SEQ ID NO: 2870 - DNA, 9 bp, Artificial Sequence
  Synthetic oligonucleotide
agctgagac

SEQ ID NO: 2871 - DNA, 9 bp, Artificial Sequence
  Synthetic oligonucleotide
accaacctc

SEQ ID NO: 2872 - DNA, 9 bp, Artificial Sequence
  Synthetic oligonucleotide
agcagtctg

SEQ ID NO: 2873 - DNA, 9 bp, Artificial Sequence
  Synthetic oligonucleotide
tgctgtgtc

SEQ ID NO: 2874 - DNA, 9 bp, Artificial Sequence
  Synthetic oligonucleotide
agaaacttc

SEQ ID NO: 2875 - DNA, 9 bp, Artificial Sequence
  Synthetic oligonucleotide
aacaatgtc

SEQ ID NO: 2876 - DNA, 9 bp, Artificial Sequence
  Synthetic oligonucleotide
agaagggtg

SEQ ID NO: 2877 - DNA, 9 bp, Artificial Sequence
  Synthetic oligonucleotide
tgcagcgga

SEQ ID NO: 2878 - DNA, 9 bp, Artificial Sequence
  Synthetic oligonucleotide
agctgtgtg

SEQ ID NO: 2879 - DNA, 9 bp, Artificial Sequence
  Synthetic oligonucleotide
aatagagtc

SEQ ID NO: 2880 - DNA, 9 bp, Artificial Sequence
  Synthetic oligonucleotide
agctgagac

SEQ ID NO: 2881 - DNA, 9 bp, Artificial Sequence
  Synthetic oligonucleotide
agctgagac

SEQ ID NO: 2882 - DNA, 9 bp, Artificial Sequence
  Synthetic oligonucleotide
agtagcatt

SEQ ID NO: 2883 - DNA, 9 bp, Artificial Sequence
  Synthetic oligonucleotide
accggagtc

SEQ ID NO: 2884 - DNA, 9 bp, Artificial Sequence
  Synthetic oligonucleotide
agcagtctg

SEQ ID NO: 2885 - DNA, 9 bp, Artificial Sequence
  Synthetic oligonucleotide
agcagcaca

SEQ ID NO: 2886 - DNA, 9 bp, Artificial Sequence
  Synthetic oligonucleotide
agcagccat

SEQ ID NO: 2887 - DNA, 9 bp, Artificial Sequence
  Synthetic oligonucleotide
gccagggtc

SEQ ID NO: 2888 - DNA, 9 bp, Artificial Sequence
  Synthetic oligonucleotide
agcatctta

SEQ ID NO: 2889 - DNA, 9 bp, Artificial Sequence
  Synthetic oligonucleotide
aggagcaac

SEQ ID NO: 2890 - DNA, 9 bp, Artificial Sequence
  Synthetic oligonucleotide
agcaggttt

SEQ ID NO: 2891 - DNA, 9 bp, Artificial Sequence
  Synthetic oligonucleotide
gacagcctc

SEQ ID NO: 2892 - DNA, 9 bp, Artificial Sequence
  Synthetic oligonucleotide
agcagcaat

SEQ ID NO: 2893 - DNA, 9 bp, Artificial Sequence
  Synthetic oligonucleotide
ggcagcggt

SEQ ID NO: 2894 - DNA, 9 bp, Artificial Sequence
  Synthetic oligonucleotide
agtggagtc

SEQ ID NO: 2895 - DNA, 9 bp, Artificial Sequence
  Synthetic oligonucleotide
agcctggtc

SEQ ID NO: 2896 - DNA, 9 bp, Artificial Sequence
  Synthetic oligonucleotide
agaaccgac

SEQ ID NO: 2897 - DNA, 9 bp, Artificial Sequence
  Synthetic oligonucleotide
agcaacatg

SEQ ID NO: 2898 - DNA, 9 bp, Artificial Sequence
  Synthetic oligonucleotide
agctcagtc

SEQ ID NO: 2899 - DNA, 9 bp, Artificial Sequence
  Synthetic oligonucleotide
agctcagtc

SEQ ID NO: 2900 - DNA, 9 bp, Artificial Sequence
  Synthetic oligonucleotide
tgcaatgtc

SEQ ID NO: 2901 - DNA, 9 bp, Artificial Sequence
  Synthetic oligonucleotide
ggccccgtc

SEQ ID NO: 2902 - DNA, 9 bp, Artificial Sequence
  Synthetic oligonucleotide
agctcagtc

SEQ ID NO: 2903 - DNA, 9 bp, Artificial Sequence
  Synthetic oligonucleotide
agcaatgta

SEQ ID NO: 2904 - DNA, 9 bp, Artificial Sequence
  Synthetic oligonucleotide
agtaacatc

SEQ ID NO: 2905 - DNA, 9 bp, Artificial Sequence
  Synthetic oligonucleotide
atcattgtc

SEQ ID NO: 2906 - DNA, 9 bp, Artificial Sequence
  Synthetic oligonucleotide
agtagagtt

SEQ ID NO: 2907 - DNA, 9 bp, Artificial Sequence
  Synthetic oligonucleotide
agcaggggt

SEQ ID NO: 2908 - DNA, 9 bp, Artificial Sequence
  Synthetic oligonucleotide
tgctgtgtc

SEQ ID NO: 2909 - DNA, 9 bp, Artificial Sequence
  Synthetic oligonucleotide
attagagtc

SEQ ID NO: 2910 - DNA, 9 bp, Artificial Sequence
  Synthetic oligonucleotide
agaagggtg

SEQ ID NO: 2911 - DNA, 9 bp, Artificial Sequence
  Synthetic oligonucleotide
ctcagtgtc

SEQ ID NO: 2912 - DNA, 9 bp, Artificial Sequence
  Synthetic oligonucleotide
agctgtgtt

SEQ ID NO: 2913 - DNA, 9 bp, Artificial Sequence
  Synthetic oligonucleotide
agtacagtc

SEQ ID NO: 2914 - DNA, 9 bp, Artificial Sequence
  Synthetic oligonucleotide
agccgcttt

SEQ ID NO: 2915 - DNA, 9 bp, Artificial Sequence
  Synthetic oligonucleotide
accggtgtc

SEQ ID NO: 2916 - DNA, 9 bp, Artificial Sequence
  Synthetic oligonucleotide
agcagtgct

SEQ ID NO: 2917 - DNA, 9 bp, Artificial Sequence
  Synthetic oligonucleotide
agctcagtc

SEQ ID NO: 2918 - DNA, 9 bp, Artificial Sequence
  Synthetic oligonucleotide
atctgcatc

SEQ ID NO: 2919 - DNA, 9 bp, Artificial Sequence
  Synthetic oligonucleotide
agcacaatc

SEQ ID NO: 2920 - DNA, 9 bp, Artificial Sequence
  Synthetic oligonucleotide
agctcagtc

SEQ ID NO: 2921 - DNA, 9 bp, Artificial Sequence
  Synthetic oligonucleotide
atcatcatc

SEQ ID NO: 2922 - DNA, 9 bp, Artificial Sequence
  Synthetic oligonucleotide
ggtagagtc

SEQ ID NO: 2923 - DNA, 9 bp, Artificial Sequence
  Synthetic oligonucleotide
agctgtgtg

SEQ ID NO: 2924 - DNA, 9 bp, Artificial Sequence
  Synthetic oligonucleotide
atgagtgtc

SEQ ID NO: 2925 - DNA, 9 bp, Artificial Sequence
  Synthetic oligonucleotide
ggcagagtg

SEQ ID NO: 2926 - DNA, 9 bp, Artificial Sequence
  Synthetic oligonucleotide
aggagtctc

SEQ ID NO: 2927 - DNA, 9 bp, Artificial Sequence
  Synthetic oligonucleotide
agccaagtc

SEQ ID NO: 2928 - DNA, 9 bp, Artificial Sequence
  Synthetic oligonucleotide
cgctgagtc

SEQ ID NO: 2929 - DNA, 9 bp, Artificial Sequence
  Synthetic oligonucleotide
ggctccgtc

SEQ ID NO: 2930 - DNA, 9 bp, Artificial Sequence
  Synthetic oligonucleotide
agcagcagt

SEQ ID NO: 2931 - DNA, 9 bp, Artificial Sequence
  Synthetic oligonucleotide
agtactgtc

SEQ ID NO: 2932 - DNA, 9 bp, Artificial Sequence
  Synthetic oligonucleotide
atgagcggc

SEQ ID NO: 2933 - DNA, 9 bp, Artificial Sequence
  Synthetic oligonucleotide
tgcaaggtc

SEQ ID NO: 2934 - DNA, 9 bp, Artificial Sequence
  Synthetic oligonucleotide
agtacagtc

SEQ ID NO: 2935 - DNA, 9 bp, Artificial Sequence
  Synthetic oligonucleotide
atcattgtc

SEQ ID NO: 2936 - DNA, 9 bp, Artificial Sequence
  Synthetic oligonucleotide
ctcagcggc

SEQ ID NO: 2937 - DNA, 9 bp, Artificial Sequence
  Synthetic oligonucleotide
agcagtccc

SEQ ID NO: 2938 - DNA, 9 bp, Artificial Sequence
  Synthetic oligonucleotide
agcacaggc

SEQ ID NO: 2939 - DNA, 9 bp, Artificial Sequence
  Synthetic oligonucleotide
agcaaccac

SEQ ID NO: 2940 - DNA, 9 bp, Artificial Sequence
  Synthetic oligonucleotide
agtaaggtc

SEQ ID NO: 2941 - DNA, 9 bp, Artificial Sequence
  Synthetic oligonucleotide
cgccccgtc

SEQ ID NO: 2942 - DNA, 9 bp, Artificial Sequence
  Synthetic oligonucleotide
tgcacagtc

SEQ ID NO: 2943 - DNA, 9 bp, Artificial Sequence
  Synthetic oligonucleotide
agcagcaag

SEQ ID NO: 2944 - DNA, 9 bp, Artificial Sequence
  Synthetic oligonucleotide
agctcagtc

SEQ ID NO: 2945 - DNA, 9 bp, Artificial Sequence
  Synthetic oligonucleotide
ggcagggtt

SEQ ID NO: 2946 - DNA, 9 bp, Artificial Sequence
  Synthetic oligonucleotide
aggatggtc

SEQ ID NO: 2947 - DNA, 9 bp, Artificial Sequence
  Synthetic oligonucleotide
agcaacccc

SEQ ID NO: 2948 - DNA, 9 bp, Artificial Sequence
  Synthetic oligonucleotide
agaagccac

SEQ ID NO: 2949 - DNA, 9 bp, Artificial Sequence
  Synthetic oligonucleotide
accaatgtc

SEQ ID NO: 2950 - DNA, 9 bp, Artificial Sequence
  Synthetic oligonucleotide
aggtgcgtg

SEQ ID NO: 2951 - DNA, 9 bp, Artificial Sequence
  Synthetic oligonucleotide
agcagtgaa

SEQ ID NO: 2952 - DNA, 9 bp, Artificial Sequence
  Synthetic oligonucleotide
agctgagtg

SEQ ID NO: 2953 - DNA, 9 bp, Artificial Sequence
  Synthetic oligonucleotide
agcagtgcg

SEQ ID NO: 2954 - DNA, 9 bp, Artificial Sequence
  Synthetic oligonucleotide
ggcggggtc

SEQ ID NO: 2955 - DNA, 9 bp, Artificial Sequence
  Synthetic oligonucleotide
agaatagtc

SEQ ID NO: 2956 - DNA, 9 bp, Artificial Sequence
  Synthetic oligonucleotide
agcagggat

SEQ ID NO: 2957 - DNA, 9 bp, Artificial Sequence
  Synthetic oligonucleotide
ggaagtgtc

SEQ ID NO: 2958 - DNA, 9 bp, Artificial Sequence
  Synthetic oligonucleotide
atcaatgtc

SEQ ID NO: 2959 - DNA, 9 bp, Artificial Sequence
  Synthetic oligonucleotide
cccagcttc

SEQ ID NO: 2960 - DNA, 9 bp, Artificial Sequence
  Synthetic oligonucleotide
aggtgcggc

SEQ ID NO: 2961 - DNA, 9 bp, Artificial Sequence
  Synthetic oligonucleotide
agctgagac

SEQ ID NO: 2962 - DNA, 9 bp, Artificial Sequence
  Synthetic oligonucleotide
agcaacatg

SEQ ID NO: 2963 - DNA, 9 bp, Artificial Sequence
  Synthetic oligonucleotide
tgcgccgtc

SEQ ID NO: 2964 - DNA, 9 bp, Artificial Sequence
  Synthetic oligonucleotide
agcaaagtt

SEQ ID NO: 2965 - DNA, 9 bp, Artificial Sequence
  Synthetic oligonucleotide
agcaaagtt

SEQ ID NO: 2966 - DNA, 9 bp, Artificial Sequence
  Synthetic oligonucleotide
agcaaagtt

SEQ ID NO: 2967 - DNA, 9 bp, Artificial Sequence
  Synthetic oligonucleotide
agcaaagtt

SEQ ID NO: 2968 - DNA, 9 bp, Artificial Sequence
  Synthetic oligonucleotide
agcaaagtt

SEQ ID NO: 2969 - DNA, 9 bp, Artificial Sequence
  Synthetic oligonucleotide
agtatcatc

SEQ ID NO: 2970 - DNA, 9 bp, Artificial Sequence
  Synthetic oligonucleotide
agctgagac

SEQ ID NO: 2971 - DNA, 9 bp, Artificial Sequence
  Synthetic oligonucleotide
aggagcaac

SEQ ID NO: 2972 - DNA, 9 bp, Artificial Sequence
  Synthetic oligonucleotide
agcagctcg

SEQ ID NO: 2973 - DNA, 9 bp, Artificial Sequence
  Synthetic oligonucleotide
agctgagac

SEQ ID NO: 2974 - DNA, 9 bp, Artificial Sequence
  Synthetic oligonucleotide
agcaatgtg

SEQ ID NO: 2975 - DNA, 9 bp, Artificial Sequence
  Synthetic oligonucleotide
agaagcggt

SEQ ID NO: 2976 - DNA, 9 bp, Artificial Sequence
  Synthetic oligonucleotide
agaagtgcc

SEQ ID NO: 2977 - DNA, 9 bp, Artificial Sequence
  Synthetic oligonucleotide
ggatgagtc

SEQ ID NO: 2978 - DNA, 9 bp, Artificial Sequence
  Synthetic oligonucleotide
acaggtgtc

SEQ ID NO: 2979 - DNA, 9 bp, Artificial Sequence
  Synthetic oligonucleotide
ctgggcgtc

SEQ ID NO: 2980 - DNA, 9 bp, Artificial Sequence
  Synthetic oligonucleotide
cccggggtc

SEQ ID NO: 2981 - DNA, 9 bp, Artificial Sequence
  Synthetic oligonucleotide
tggcacgtc

SEQ ID NO: 2982 - DNA, 9 bp, Artificial Sequence
  Synthetic oligonucleotide
agctcagta

SEQ ID NO: 2983 - DNA, 9 bp, Artificial Sequence
  Synthetic oligonucleotide
aaaaggttc

SEQ ID NO: 2984 - DNA, 9 bp, Artificial Sequence
  Synthetic oligonucleotide
gacatcatc

SEQ ID NO: 2985 - DNA, 9 bp, Artificial Sequence
  Synthetic oligonucleotide
agcactatt

SEQ ID NO: 2986 - DNA, 9 bp, Artificial Sequence
  Synthetic oligonucleotide
ccctgagtc

SEQ ID NO: 2987 - DNA, 9 bp, Artificial Sequence
  Synthetic oligonucleotide
tggggagtc

SEQ ID NO: 2988 - DNA, 9 bp, Artificial Sequence
  Synthetic oligonucleotide
aacagggct

SEQ ID NO: 2989 - DNA, 9 bp, Artificial Sequence
  Synthetic oligonucleotide
agcaaagct

SEQ ID NO: 2990 - DNA, 9 bp, Artificial Sequence
  Synthetic oligonucleotide
aacattgtt

SEQ ID NO: 2991 - DNA, 9 bp, Artificial Sequence
  Synthetic oligonucleotide
agacacttc

SEQ ID NO: 2992 - DNA, 9 bp, Artificial Sequence
  Synthetic oligonucleotide
gcccacgtc

SEQ ID NO: 2993 - DNA, 9 bp, Artificial Sequence
  Synthetic oligonucleotide
aacatggtt

SEQ ID NO: 2994 - DNA, 9 bp, Artificial Sequence
  Synthetic oligonucleotide
ggtacagtc

SEQ ID NO: 2995 - DNA, 9 bp, Artificial Sequence
  Synthetic oligonucleotide
ggcatggtg

SEQ ID NO: 2996 - DNA, 9 bp, Artificial Sequence
  Synthetic oligonucleotide
ggaagtctc

SEQ ID NO: 2997 - DNA, 9 bp, Artificial Sequence
  Synthetic oligonucleotide
atcttggtc

SEQ ID NO: 2998 - DNA, 9 bp, Artificial Sequence
  Synthetic oligonucleotide
atcaggtcc

SEQ ID NO: 2999 - DNA, 9 bp, Artificial Sequence
  Synthetic oligonucleotide
ggcatggtg

SEQ ID NO: 3000 - DNA, 9 bp, Artificial Sequence
  Synthetic oligonucleotide
tgaaacgtt

SEQ ID NO: 3001 - DNA, 9 bp, Artificial Sequence
  Synthetic oligonucleotide
tgaatcggc

SEQ ID NO: 3002 - DNA, 9 bp, Artificial Sequence
  Synthetic oligonucleotide
atacacgtc

SEQ ID NO: 3003 - DNA, 9 bp, Artificial Sequence
  Synthetic oligonucleotide
gggaaggtc

SEQ ID NO: 3004 - DNA, 9 bp, Artificial Sequence
  Synthetic oligonucleotide
cactgtgtc

SEQ ID NO: 3005 - DNA, 9 bp, Artificial Sequence
  Synthetic oligonucleotide
atctttgtc

SEQ ID NO: 3006 - DNA, 9 bp, Artificial Sequence
  Synthetic oligonucleotide
ctgagggtc

SEQ ID NO: 3007 - DNA, 9 bp, Artificial Sequence
  Synthetic oligonucleotide
atgtgagtc

SEQ ID NO: 3008 - DNA, 9 bp, Artificial Sequence
  Synthetic oligonucleotide
aaagtcgtc

SEQ ID NO: 3009 - DNA, 9 bp, Artificial Sequence
  Synthetic oligonucleotide
aacaatgtt

SEQ ID NO: 3010 - DNA, 9 bp, Artificial Sequence
  Synthetic oligonucleotide
gggaaggtc

SEQ ID NO: 3011 - DNA, 9 bp, Artificial Sequence
  Synthetic oligonucleotide
ggatgtgtc

SEQ ID NO: 3012 - DNA, 9 bp, Artificial Sequence
  Synthetic oligonucleotide
tccacagtc

SEQ ID NO: 3013 - DNA, 9 bp, Artificial Sequence
  Synthetic oligonucleotide
agcaaagct

SEQ ID NO: 3014 - DNA, 9 bp, Artificial Sequence
  Synthetic oligonucleotide
ccctgggtc

SEQ ID NO: 3015 - DNA, 9 bp, Artificial Sequence
  Synthetic oligonucleotide
gtgagggtc

SEQ ID NO: 3016 - DNA, 9 bp, Artificial Sequence
  Synthetic oligonucleotide
agccaggtt

SEQ ID NO: 3017 - DNA, 9 bp, Artificial Sequence
  Synthetic oligonucleotide
agcatggct

SEQ ID NO: 3018 - DNA, 9 bp, Artificial Sequence
  Synthetic oligonucleotide
agctcaggc

SEQ ID NO: 3019 - DNA, 9 bp, Artificial Sequence
  Synthetic oligonucleotide
ccctgggtc

SEQ ID NO: 3020 - DNA, 9 bp, Artificial Sequence
  Synthetic oligonucleotide
agcaacaga

SEQ ID NO: 3021 - DNA, 9 bp, Artificial Sequence
  Synthetic oligonucleotide
agcatggct

SEQ ID NO: 3022 - DNA, 9 bp, Artificial Sequence
  Synthetic oligonucleotide
agctaagtt

SEQ ID NO: 3023 - DNA, 9 bp, Artificial Sequence
  Synthetic oligonucleotide
aactttgtc

SEQ ID NO: 3024 - DNA, 9 bp, Artificial Sequence
  Synthetic oligonucleotide
aacatggtt

SEQ ID NO: 3025 - DNA, 9 bp, Artificial Sequence
  Synthetic oligonucleotide
cgccacggc

SEQ ID NO: 3026 - DNA, 9 bp, Artificial Sequence
  Synthetic oligonucleotide
ctcattgtc

SEQ ID NO: 3027 - DNA, 9 bp, Artificial Sequence
  Synthetic oligonucleotide
ccctgggtc

SEQ ID NO: 3028 - DNA, 9 bp, Artificial Sequence
  Synthetic oligonucleotide
agcaacgtc

SEQ ID NO: 3029 - DNA, 9 bp, Artificial Sequence
  Synthetic oligonucleotide
agcagcggc

SEQ ID NO: 3030 - DNA, 9 bp, Artificial Sequence
  Synthetic oligonucleotide
agcagcggc

SEQ ID NO: 3031 - DNA, 9 bp, Artificial Sequence
  Synthetic oligonucleotide
agcagcggc

SEQ ID NO: 3032 - DNA, 9 bp, Artificial Sequence
  Synthetic oligonucleotide
agcaccgtc

SEQ ID NO: 3033 - DNA, 9 bp, Artificial Sequence
  Synthetic oligonucleotide
agcaccgtc

SEQ ID NO: 3034 - DNA, 9 bp, Artificial Sequence
  Synthetic oligonucleotide
agcacagtc

SEQ ID NO: 3035 - DNA, 9 bp, Artificial Sequence
  Synthetic oligonucleotide
agcaacgta

SEQ ID NO: 3036 - DNA, 9 bp, Artificial Sequence
  Synthetic oligonucleotide
agcatcggc

SEQ ID NO: 3037 - DNA, 9 bp, Artificial Sequence
  Synthetic oligonucleotide
aacaacgtc

SEQ ID NO: 3038 - DNA, 9 bp, Artificial Sequence
  Synthetic oligonucleotide
agcatagtc

SEQ ID NO: 3039 - DNA, 9 bp, Artificial Sequence
  Synthetic oligonucleotide
agcatggtc

SEQ ID NO: 3040 - DNA, 9 bp, Artificial Sequence
  Synthetic oligonucleotide
agctgtgtc

SEQ ID NO: 3041 - DNA, 9 bp, Artificial Sequence
  Synthetic oligonucleotide
agcaatgtc

SEQ ID NO: 3042 - DNA, 9 bp, Artificial Sequence
  Synthetic oligonucleotide
agcattgtc

SEQ ID NO: 3043 - DNA, 9 bp, Artificial Sequence
  Synthetic oligonucleotide
agcagctgc

SEQ ID NO: 3044 - DNA, 9 bp, Artificial Sequence
  Synthetic oligonucleotide
tgcagtgtc

SEQ ID NO: 3045 - DNA, 9 bp, Artificial Sequence
  Synthetic oligonucleotide
agcattgtc

SEQ ID NO: 3046 - DNA, 9 bp, Artificial Sequence
  Synthetic oligonucleotide
agcattgtc

SEQ ID NO: 3047 - DNA, 9 bp, Artificial Sequence
  Synthetic oligonucleotide
agcaatgtc

SEQ ID NO: 3048 - DNA, 9 bp, Artificial Sequence
  Synthetic oligonucleotide
agcaacgtt

SEQ ID NO: 3049 - DNA, 9 bp, Artificial Sequence
  Synthetic oligonucleotide
agcaacttc

SEQ ID NO: 3050 - DNA, 9 bp, Artificial Sequence
  Synthetic oligonucleotide
aggcgagtc

SEQ ID NO: 3051 - DNA, 9 bp, Artificial Sequence
  Synthetic oligonucleotide
agccacgtt

SEQ ID NO: 3052 - DNA, 9 bp, Artificial Sequence
  Synthetic oligonucleotide
agtatcgtg

SEQ ID NO: 3053 - DNA, 9 bp, Artificial Sequence
  Synthetic oligonucleotide
agcaaggta

SEQ ID NO: 3054 - DNA, 9 bp, Artificial Sequence
  Synthetic oligonucleotide
tgcagctgc

SEQ ID NO: 3055 - DNA, 9 bp, Artificial Sequence
  Synthetic oligonucleotide
agtatcttc

SEQ ID NO: 3056 - DNA, 9 bp, Artificial Sequence
  Synthetic oligonucleotide
tgcagtttc

SEQ ID NO: 3057 - DNA, 9 bp, Artificial Sequence
  Synthetic oligonucleotide
atcaggggc

SEQ ID NO: 3058 - DNA, 9 bp, Artificial Sequence
  Synthetic oligonucleotide
agttgcttc

SEQ ID NO: 3059 - DNA, 9 bp, Artificial Sequence
  Synthetic oligonucleotide
agctacgtg

SEQ ID NO: 3060 - DNA, 9 bp, Artificial Sequence
  Synthetic oligonucleotide
agcttagtc

SEQ ID NO: 3061 - DNA, 9 bp, Artificial Sequence
  Synthetic oligonucleotide
atcaggggc

SEQ ID NO: 3062 - DNA, 9 bp, Artificial Sequence
  Synthetic oligonucleotide
atcaggggc

SEQ ID NO: 3063 - DNA, 9 bp, Artificial Sequence
  Synthetic oligonucleotide
agcaacccc

SEQ ID NO: 3064 - DNA, 9 bp, Artificial Sequence
  Synthetic oligonucleotide
agcatggta

SEQ ID NO: 3065 - DNA, 9 bp, Artificial Sequence
  Synthetic oligonucleotide
catagcgtc

SEQ ID NO: 3066 - DNA, 9 bp, Artificial Sequence
  Synthetic oligonucleotide
tgcagctgc

SEQ ID NO: 3067 - DNA, 9 bp, Artificial Sequence
  Synthetic oligonucleotide
agctaggtc

SEQ ID NO: 3068 - DNA, 9 bp, Artificial Sequence
  Synthetic oligonucleotide
agcttggtc

SEQ ID NO: 3069 - DNA, 9 bp, Artificial Sequence
  Synthetic oligonucleotide
agcaactac

SEQ ID NO: 3070 - DNA, 9 bp, Artificial Sequence
  Synthetic oligonucleotide
agcaacccc

SEQ ID NO: 3071 - DNA, 9 bp, Artificial Sequence
  Synthetic oligonucleotide
gtcagtgtc

SEQ ID NO: 3072 - DNA, 9 bp, Artificial Sequence
  Synthetic oligonucleotide
tgcagtgta

SEQ ID NO: 3073 - DNA, 9 bp, Artificial Sequence
  Synthetic oligonucleotide
ctcatcgtc

SEQ ID NO: 3074 - DNA, 9 bp, Artificial Sequence
  Synthetic oligonucleotide
agtaacatc

SEQ ID NO: 3075 - DNA, 9 bp, Artificial Sequence
  Synthetic oligonucleotide
agctatgtc

SEQ ID NO: 3076 - DNA, 9 bp, Artificial Sequence
  Synthetic oligonucleotide
gtccgcgtc

SEQ ID NO: 3077 - DNA, 9 bp, Artificial Sequence
  Synthetic oligonucleotide
agccttgtc

SEQ ID NO: 3078 - DNA, 9 bp, Artificial Sequence
  Synthetic oligonucleotide
agcacagcc

SEQ ID NO: 3079 - DNA, 9 bp, Artificial Sequence
  Synthetic oligonucleotide
agcaacatt

SEQ ID NO: 3080 - DNA, 9 bp, Artificial Sequence
  Synthetic oligonucleotide
agtgtggtc

SEQ ID NO: 3081 - DNA, 9 bp, Artificial Sequence
  Synthetic oligonucleotide
actaatgtc

SEQ ID NO: 3082 - DNA, 9 bp, Artificial Sequence
  Synthetic oligonucleotide
tacattgtc

SEQ ID NO: 3083 - DNA, 9 bp, Artificial Sequence
  Synthetic oligonucleotide
atcaatggc

SEQ ID NO: 3084 - DNA, 9 bp, Artificial Sequence
  Synthetic oligonucleotide
cggggagtc

SEQ ID NO: 3085 - DNA, 9 bp, Artificial Sequence
  Synthetic oligonucleotide
agcaggtca

SEQ ID NO: 3086 - DNA, 9 bp, Artificial Sequence
  Synthetic oligonucleotide
agctaggtt

SEQ ID NO: 3087 - DNA, 9 bp, Artificial Sequence
  Synthetic oligonucleotide
agtgtggtc

SEQ ID NO: 3088 - DNA, 9 bp, Artificial Sequence
  Synthetic oligonucleotide
agtatggta

SEQ ID NO: 3089 - DNA, 9 bp, Artificial Sequence
  Synthetic oligonucleotide
atccgtctc

SEQ ID NO: 3090 - DNA, 9 bp, Artificial Sequence
  Synthetic oligonucleotide
aacagtatt

SEQ ID NO: 3091 - DNA, 9 bp, Artificial Sequence
  Synthetic oligonucleotide
atcagcagt

SEQ ID NO: 3092 - DNA, 9 bp, Artificial Sequence
  Synthetic oligonucleotide
ggccaagtc

SEQ ID NO: 3093 - DNA, 9 bp, Artificial Sequence
  Synthetic oligonucleotide
gccagtgtt

SEQ ID NO: 3094 - DNA, 9 bp, Artificial Sequence
  Synthetic oligonucleotide
atcagggca

SEQ ID NO: 3095 - DNA, 9 bp, Artificial Sequence
  Synthetic oligonucleotide
agtagatgc

SEQ ID NO: 3096 - DNA, 9 bp, Artificial Sequence
  Synthetic oligonucleotide
ggcctggtc

SEQ ID NO: 3097 - DNA, 9 bp, Artificial Sequence
  Synthetic oligonucleotide
agcaactca

SEQ ID NO: 3098 - DNA, 9 bp, Artificial Sequence
  Synthetic oligonucleotide
gggggagtc

SEQ ID NO: 3099 - DNA, 9 bp, Artificial Sequence
  Synthetic oligonucleotide
atcagtcta

SEQ ID NO: 3100 - DNA, 9 bp, Artificial Sequence
  Synthetic oligonucleotide
agtagatgc

SEQ ID NO: 3101 - DNA, 9 bp, Artificial Sequence
  Synthetic oligonucleotide
accagtggt

SEQ ID NO: 3102 - DNA, 9 bp, Artificial Sequence
  Synthetic oligonucleotide
ggccttgtc

SEQ ID NO: 3103 - DNA, 9 bp, Artificial Sequence
  Synthetic oligonucleotide
ctcattgtc

SEQ ID NO: 3104 - DNA, 9 bp, Artificial Sequence
  Synthetic oligonucleotide
agtatggta

SEQ ID NO: 3105 - DNA, 9 bp, Artificial Sequence
  Synthetic oligonucleotide
agagaggtc

SEQ ID NO: 3106 - DNA, 9 bp, Artificial Sequence
  Synthetic oligonucleotide
ggcctggtc

SEQ ID NO: 3107 - DNA, 9 bp, Artificial Sequence
  Synthetic oligonucleotide
tgttgagtc

SEQ ID NO: 3108 - DNA, 9 bp, Artificial Sequence
  Synthetic oligonucleotide
agcaccact

SEQ ID NO: 3109 - DNA, 9 bp, Artificial Sequence
  Synthetic oligonucleotide
aaaacagtc

SEQ ID NO: 3110 - DNA, 9 bp, Artificial Sequence
  Synthetic oligonucleotide
aacagtatt

SEQ ID NO: 3111 - DNA, 9 bp, Artificial Sequence
  Synthetic oligonucleotide
gccaacatc

SEQ ID NO: 3112 - DNA, 9 bp, Artificial Sequence
  Synthetic oligonucleotide
ggccaagtc

SEQ ID NO: 3113 - DNA, 9 bp, Artificial Sequence
  Synthetic oligonucleotide
aaaacagtc

SEQ ID NO: 3114 - DNA, 9 bp, Artificial Sequence
  Synthetic oligonucleotide
aatcccgtc

SEQ ID NO: 3115 - DNA, 9 bp, Artificial Sequence
  Synthetic oligonucleotide
ggttacgtc

SEQ ID NO: 3116 - DNA, 9 bp, Artificial Sequence
  Synthetic oligonucleotide
agttacttc

SEQ ID NO: 3117 - DNA, 9 bp, Artificial Sequence
  Synthetic oligonucleotide
agttacttc

SEQ ID NO: 3118 - DNA, 9 bp, Artificial Sequence
  Synthetic oligonucleotide
ggcatcgtc

SEQ ID NO: 3119 - DNA, 9 bp, Artificial Sequence
  Synthetic oligonucleotide
atcagggtc

SEQ ID NO: 3120 - DNA, 9 bp, Artificial Sequence
  Synthetic oligonucleotide
agctcagtc

SEQ ID NO: 3121 - DNA, 9 bp, Artificial Sequence
  Synthetic oligonucleotide
agctcagtc

SEQ ID NO: 3122 - DNA, 9 bp, Artificial Sequence
  Synthetic oligonucleotide
agcatggtt

SEQ ID NO: 3123 - DNA, 9 bp, Artificial Sequence
  Synthetic oligonucleotide
agatgggtc

SEQ ID NO: 3124 - DNA, 9 bp, Artificial Sequence
  Synthetic oligonucleotide
agatgggtc

SEQ ID NO: 3125 - DNA, 9 bp, Artificial Sequence
  Synthetic oligonucleotide
agcagagtc

SEQ ID NO: 3126 - DNA, 9 bp, Artificial Sequence
  Synthetic oligonucleotide
agcagagtc

SEQ ID NO: 3127 - DNA, 9 bp, Artificial Sequence
  Synthetic oligonucleotide
agcagcgtc

SEQ ID NO: 3128 - DNA, 9 bp, Artificial Sequence
  Synthetic oligonucleotide
agcagcgtc

SEQ ID NO: 3129 - DNA, 9 bp, Artificial Sequence
  Synthetic oligonucleotide
agcagcgtc

SEQ ID NO: 3130 - DNA, 9 bp, Artificial Sequence
  Synthetic oligonucleotide
agcagcgtc

SEQ ID NO: 3131 - DNA, 9 bp, Artificial Sequence
  Synthetic oligonucleotide
agcagtgtc

SEQ ID NO: 3132 - DNA, 9 bp, Artificial Sequence
  Synthetic oligonucleotide
agcagcttc

SEQ ID NO: 3133 - DNA, 9 bp, Artificial Sequence
  Synthetic oligonucleotide
agcagtgtc

SEQ ID NO: 3134 - DNA, 9 bp, Artificial Sequence
  Synthetic oligonucleotide
tgcagcgtc

SEQ ID NO: 3135 - DNA, 9 bp, Artificial Sequence
  Synthetic oligonucleotide
agcagtgtc

SEQ ID NO: 3136 - DNA, 9 bp, Artificial Sequence
  Synthetic oligonucleotide
agcagcttc

SEQ ID NO: 3137 - DNA, 9 bp, Artificial Sequence
  Synthetic oligonucleotide
agcagtgtc

SEQ ID NO: 3138 - DNA, 9 bp, Artificial Sequence
  Synthetic oligonucleotide
agcagcttc

SEQ ID NO: 3139 - DNA, 9 bp, Artificial Sequence
  Synthetic oligonucleotide
agcagcgtg

SEQ ID NO: 3140 - DNA, 9 bp, Artificial Sequence
  Synthetic oligonucleotide
agcagcgtt

SEQ ID NO: 3141 - DNA, 9 bp, Artificial Sequence
  Synthetic oligonucleotide
agaagcgtc

SEQ ID NO: 3142 - DNA, 9 bp, Artificial Sequence
  Synthetic oligonucleotide
agcagcatc

SEQ ID NO: 3143 - DNA, 9 bp, Artificial Sequence
  Synthetic oligonucleotide
agcagcggc

SEQ ID NO: 3144 - DNA, 9 bp, Artificial Sequence
  Synthetic oligonucleotide
agcatcgtc

SEQ ID NO: 3145 - DNA, 9 bp, Artificial Sequence
  Synthetic oligonucleotide
agcagcttc

SEQ ID NO: 3146 - DNA, 9 bp, Artificial Sequence
  Synthetic oligonucleotide
agcagcgtt

SEQ ID NO: 3147 - DNA, 9 bp, Artificial Sequence
  Synthetic oligonucleotide
agcagcatc

SEQ ID NO: 3148 - DNA, 9 bp, Artificial Sequence
  Synthetic oligonucleotide
agcagggtc

SEQ ID NO: 3149 - DNA, 9 bp, Artificial Sequence
  Synthetic oligonucleotide
agcagggtc

SEQ ID NO: 3150 - DNA, 9 bp, Artificial Sequence
  Synthetic oligonucleotide
agcagcgcc

SEQ ID NO: 3151 - DNA, 9 bp, Artificial Sequence
  Synthetic oligonucleotide
agcaccgtc

SEQ ID NO: 3152 - DNA, 9 bp, Artificial Sequence
  Synthetic oligonucleotide
agcagagtc

SEQ ID NO: 3153 - DNA, 9 bp, Artificial Sequence
  Synthetic oligonucleotide
agcagcgtg

SEQ ID NO: 3154 - DNA, 9 bp, Artificial Sequence
  Synthetic oligonucleotide
agcagggtc

SEQ ID NO: 3155 - DNA, 9 bp, Artificial Sequence
  Synthetic oligonucleotide
agcagggtc

SEQ ID NO: 3156 - DNA, 9 bp, Artificial Sequence
  Synthetic oligonucleotide
ggcagcgtc

SEQ ID NO: 3157 - DNA, 9 bp, Artificial Sequence
  Synthetic oligonucleotide
agcagtgtc

SEQ ID NO: 3158 - DNA, 9 bp, Artificial Sequence
  Synthetic oligonucleotide
agcagcctc

SEQ ID NO: 3159 - DNA, 9 bp, Artificial Sequence
  Synthetic oligonucleotide
agcagcgtt

SEQ ID NO: 3160 - DNA, 9 bp, Artificial Sequence
  Synthetic oligonucleotide
agcagcgac

SEQ ID NO: 3161 - DNA, 9 bp, Artificial Sequence
  Synthetic oligonucleotide
agcagagtc

SEQ ID NO: 3162 - DNA, 9 bp, Artificial Sequence
  Synthetic oligonucleotide
agcagcatc

SEQ ID NO: 3163 - DNA, 9 bp, Artificial Sequence
  Synthetic oligonucleotide
agctgagtc

SEQ ID NO: 3164 - DNA, 9 bp, Artificial Sequence
  Synthetic oligonucleotide
ggcagtgtc

SEQ ID NO: 3165 - DNA, 9 bp, Artificial Sequence
  Synthetic oligonucleotide
agcaacttc

SEQ ID NO: 3166 - DNA, 9 bp, Artificial Sequence
  Synthetic oligonucleotide
agcatcttc

SEQ ID NO: 3167 - DNA, 9 bp, Artificial Sequence
  Synthetic oligonucleotide
ggcagggtc

SEQ ID NO: 3168 - DNA, 9 bp, Artificial Sequence
  Synthetic oligonucleotide
agcagtgtg

SEQ ID NO: 3169 - DNA, 9 bp, Artificial Sequence
  Synthetic oligonucleotide
agcagtgta

SEQ ID NO: 3170 - DNA, 9 bp, Artificial Sequence
  Synthetic oligonucleotide
agctgggtc

SEQ ID NO: 3171 - DNA, 9 bp, Artificial Sequence
  Synthetic oligonucleotide
agcagcgag

SEQ ID NO: 3172 - DNA, 9 bp, Artificial Sequence
  Synthetic oligonucleotide
agcagcttg

SEQ ID NO: 3173 - DNA, 9 bp, Artificial Sequence
  Synthetic oligonucleotide
agcagcagc

SEQ ID NO: 3174 - DNA, 9 bp, Artificial Sequence
  Synthetic oligonucleotide
agcaccatc

SEQ ID NO: 3175 - DNA, 9 bp, Artificial Sequence
  Synthetic oligonucleotide
agcagagtt

SEQ ID NO: 3176 - DNA, 9 bp, Artificial Sequence
  Synthetic oligonucleotide
ggcagggtc

SEQ ID NO: 3177 - DNA, 9 bp, Artificial Sequence
  Synthetic oligonucleotide
ggcagtgtc

SEQ ID NO: 3178 - DNA, 9 bp, Artificial Sequence
  Synthetic oligonucleotide
tgcaacgtc

SEQ ID NO: 3179 - DNA, 9 bp, Artificial Sequence
  Synthetic oligonucleotide
aacagtgtc

SEQ ID NO: 3180 - DNA, 9 bp, Artificial Sequence
  Synthetic oligonucleotide
agcagtgta

SEQ ID NO: 3181 - DNA, 9 bp, Artificial Sequence
  Synthetic oligonucleotide
agctgtgtc

SEQ ID NO: 3182 - DNA, 9 bp, Artificial Sequence
  Synthetic oligonucleotide
agcagcgga

SEQ ID NO: 3183 - DNA, 9 bp, Artificial Sequence
  Synthetic oligonucleotide
aacagcttc

SEQ ID NO: 3184 - DNA, 9 bp, Artificial Sequence
  Synthetic oligonucleotide
agtagagtc

SEQ ID NO: 3185 - DNA, 9 bp, Artificial Sequence
  Synthetic oligonucleotide
agcagcgaa

SEQ ID NO: 3186 - DNA, 9 bp, Artificial Sequence
  Synthetic oligonucleotide
aactgcgtc

SEQ ID NO: 3187 - DNA, 9 bp, Artificial Sequence
  Synthetic oligonucleotide
agaagcctc

SEQ ID NO: 3188 - DNA, 9 bp, Artificial Sequence
  Synthetic oligonucleotide
agcagtgtg

SEQ ID NO: 3189 - DNA, 9 bp, Artificial Sequence
  Synthetic oligonucleotide
agtagagtc

SEQ ID NO: 3190 - DNA, 9 bp, Artificial Sequence
  Synthetic oligonucleotide
ggcagtgtc

SEQ ID NO: 3191 - DNA, 9 bp, Artificial Sequence
  Synthetic oligonucleotide
agcactgtc

SEQ ID NO: 3192 - DNA, 9 bp, Artificial Sequence
  Synthetic oligonucleotide
agctgggtc

SEQ ID NO: 3193 - DNA, 9 bp, Artificial Sequence
  Synthetic oligonucleotide
agcagcttt

SEQ ID NO: 3194 - DNA, 9 bp, Artificial Sequence
  Synthetic oligonucleotide
agcagtgta

SEQ ID NO: 3195 - DNA, 9 bp, Artificial Sequence
  Synthetic oligonucleotide
ggcagcgtg

SEQ ID NO: 3196 - DNA, 9 bp, Artificial Sequence
  Synthetic oligonucleotide
agcagcagc

SEQ ID NO: 3197 - DNA, 9 bp, Artificial Sequence
  Synthetic oligonucleotide
agtagcttc

SEQ ID NO: 3198 - DNA, 9 bp, Artificial Sequence
  Synthetic oligonucleotide
tgcggcgtc

SEQ ID NO: 3199 - DNA, 9 bp, Artificial Sequence
  Synthetic oligonucleotide
aacagagtc

SEQ ID NO: 3200 - DNA, 9 bp, Artificial Sequence
  Synthetic oligonucleotide
ggcagcggc

SEQ ID NO: 3201 - DNA, 9 bp, Artificial Sequence
  Synthetic oligonucleotide
agcaggctc

SEQ ID NO: 3202 - DNA, 9 bp, Artificial Sequence
  Synthetic oligonucleotide
atcaccatc

SEQ ID NO: 3203 - DNA, 9 bp, Artificial Sequence
  Synthetic oligonucleotide
agcagttta

SEQ ID NO: 3204 - DNA, 9 bp, Artificial Sequence
  Synthetic oligonucleotide
aacagcaac

SEQ ID NO: 3205 - DNA, 9 bp, Artificial Sequence
  Synthetic oligonucleotide
agctgagta

SEQ ID NO: 3206 - DNA, 9 bp, Artificial Sequence
  Synthetic oligonucleotide
agcaacctg

SEQ ID NO: 3207 - DNA, 9 bp, Artificial Sequence
  Synthetic oligonucleotide
agcaacctg

SEQ ID NO: 3208 - DNA, 9 bp, Artificial Sequence
  Synthetic oligonucleotide
tgcaggctc

SEQ ID NO: 3209 - DNA, 9 bp, Artificial Sequence
  Synthetic oligonucleotide
cgcagtatc

SEQ ID NO: 3210 - DNA, 9 bp, Artificial Sequence
  Synthetic oligonucleotide
agaaacatc

SEQ ID NO: 3211 - DNA, 9 bp, Artificial Sequence
  Synthetic oligonucleotide
acctgtgtc

SEQ ID NO: 3212 - DNA, 9 bp, Artificial Sequence
  Synthetic oligonucleotide
ggcagggcc

SEQ ID NO: 3213 - DNA, 9 bp, Artificial Sequence
  Synthetic oligonucleotide
agaaacatc

SEQ ID NO: 3214 - DNA, 9 bp, Artificial Sequence
  Synthetic oligonucleotide
aggtgcatc

SEQ ID NO: 3215 - DNA, 9 bp, Artificial Sequence
  Synthetic oligonucleotide
ggcagggcc

SEQ ID NO: 3216 - DNA, 9 bp, Artificial Sequence
  Synthetic oligonucleotide
ggcagctgc

SEQ ID NO: 3217 - DNA, 9 bp, Artificial Sequence
  Synthetic oligonucleotide
agcatggcc

SEQ ID NO: 3218 - DNA, 9 bp, Artificial Sequence
  Synthetic oligonucleotide
agcagcgtc

SEQ ID NO: 3219 - DNA, 9 bp, Artificial Sequence
  Synthetic oligonucleotide
agcagcgtc

SEQ ID NO: 3220 - DNA, 9 bp, Artificial Sequence
  Synthetic oligonucleotide
agcagcgtc

SEQ ID NO: 3221 - DNA, 9 bp, Artificial Sequence
  Synthetic oligonucleotide
agcagcgtc

SEQ ID NO: 3222 - DNA, 9 bp, Artificial Sequence
  Synthetic oligonucleotide
agcaacgtc

SEQ ID NO: 3223 - DNA, 9 bp, Artificial Sequence
  Synthetic oligonucleotide
agcagggtc

SEQ ID NO: 3224 - DNA, 9 bp, Artificial Sequence
  Synthetic oligonucleotide
agcagcgtg

SEQ ID NO: 3225 - DNA, 9 bp, Artificial Sequence
  Synthetic oligonucleotide
agcagcgtt

SEQ ID NO: 3226 - DNA, 9 bp, Artificial Sequence
  Synthetic oligonucleotide
agcaacgtc

SEQ ID NO: 3227 - DNA, 9 bp, Artificial Sequence
  Synthetic oligonucleotide
agcagggtc

SEQ ID NO: 3228 - DNA, 9 bp, Artificial Sequence
  Synthetic oligonucleotide
agcagtgtc

SEQ ID NO: 3229 - DNA, 9 bp, Artificial Sequence
  Synthetic oligonucleotide
agcaacgtc

SEQ ID NO: 3230 - DNA, 9 bp, Artificial Sequence
  Synthetic oligonucleotide
agcatcgtc

SEQ ID NO: 3231 - DNA, 9 bp, Artificial Sequence
  Synthetic oligonucleotide
agcagcttc

SEQ ID NO: 3232 - DNA, 9 bp, Artificial Sequence
  Synthetic oligonucleotide
agcaacgtc

SEQ ID NO: 3233 - DNA, 9 bp, Artificial Sequence
  Synthetic oligonucleotide
agcagcgtt

SEQ ID NO: 3234 - DNA, 9 bp, Artificial Sequence
  Synthetic oligonucleotide
agcagcgtt

SEQ ID NO: 3235 - DNA, 9 bp, Artificial Sequence
  Synthetic oligonucleotide
agcagggtc

SEQ ID NO: 3236 - DNA, 9 bp, Artificial Sequence
  Synthetic oligonucleotide
agcagtgtc

SEQ ID NO: 3237 - DNA, 9 bp, Artificial Sequence
  Synthetic oligonucleotide
agcagtgtc

SEQ ID NO: 3238 - DNA, 9 bp, Artificial Sequence
  Synthetic oligonucleotide
agcagcttc

SEQ ID NO: 3239 - DNA, 9 bp, Artificial Sequence
  Synthetic oligonucleotide
ggcagcgtc

SEQ ID NO: 3240 - DNA, 9 bp, Artificial Sequence
  Synthetic oligonucleotide
agcagcttc

SEQ ID NO: 3241 - DNA, 9 bp, Artificial Sequence
  Synthetic oligonucleotide
agcagggtc

SEQ ID NO: 3242 - DNA, 9 bp, Artificial Sequence
  Synthetic oligonucleotide
agcagcggc

SEQ ID NO: 3243 - DNA, 9 bp, Artificial Sequence
  Synthetic oligonucleotide
agcagcctc

SEQ ID NO: 3244 - DNA, 9 bp, Artificial Sequence
  Synthetic oligonucleotide
agcaacgtc

SEQ ID NO: 3245 - DNA, 9 bp, Artificial Sequence
  Synthetic oligonucleotide
agcagcgtg

SEQ ID NO: 3246 - DNA, 9 bp, Artificial Sequence
  Synthetic oligonucleotide
agcagggtc

SEQ ID NO: 3247 - DNA, 9 bp, Artificial Sequence
  Synthetic oligonucleotide
agcagtgtc

SEQ ID NO: 3248 - DNA, 9 bp, Artificial Sequence
  Synthetic oligonucleotide
agcagcggc

SEQ ID NO: 3249 - DNA, 9 bp, Artificial Sequence
  Synthetic oligonucleotide
agcagcttc

SEQ ID NO: 3250 - DNA, 9 bp, Artificial Sequence
  Synthetic oligonucleotide
agcagcttc

SEQ ID NO: 3251 - DNA, 9 bp, Artificial Sequence
  Synthetic oligonucleotide
agcagcgac

SEQ ID NO: 3252 - DNA, 9 bp, Artificial Sequence
  Synthetic oligonucleotide
agcagcggc

SEQ ID NO: 3253 - DNA, 9 bp, Artificial Sequence
  Synthetic oligonucleotide
agcagtgtc

SEQ ID NO: 3254 - DNA, 9 bp, Artificial Sequence
  Synthetic oligonucleotide
agcagcggc

SEQ ID NO: 3255 - DNA, 9 bp, Artificial Sequence
  Synthetic oligonucleotide
agcagcggc

SEQ ID NO: 3256 - DNA, 9 bp, Artificial Sequence
  Synthetic oligonucleotide
agcaacgtc

SEQ ID NO: 3257 - DNA, 9 bp, Artificial Sequence
  Synthetic oligonucleotide
agcattgtc

SEQ ID NO: 3258 - DNA, 9 bp, Artificial Sequence
  Synthetic oligonucleotide
agcatggtc

SEQ ID NO: 3259 - DNA, 9 bp, Artificial Sequence
  Synthetic oligonucleotide
agcaacatc

SEQ ID NO: 3260 - DNA, 9 bp, Artificial Sequence
  Synthetic oligonucleotide
agcaatgtc

SEQ ID NO: 3261 - DNA, 9 bp, Artificial Sequence
  Synthetic oligonucleotide
agcagctgc

SEQ ID NO: 3262 - DNA, 9 bp, Artificial Sequence
  Synthetic oligonucleotide
agctgggtc

SEQ ID NO: 3263 - DNA, 9 bp, Artificial Sequence
  Synthetic oligonucleotide
agcagctgc

SEQ ID NO: 3264 - DNA, 9 bp, Artificial Sequence
  Synthetic oligonucleotide
agcattgtc

SEQ ID NO: 3265 - DNA, 9 bp, Artificial Sequence
  Synthetic oligonucleotide
agcaaagtc

SEQ ID NO: 3266 - DNA, 9 bp, Artificial Sequence
  Synthetic oligonucleotide
agcagggtg

SEQ ID NO: 3267 - DNA, 9 bp, Artificial Sequence
  Synthetic oligonucleotide
atcaacgtc

SEQ ID NO: 3268 - DNA, 9 bp, Artificial Sequence
  Synthetic oligonucleotide
agcagcttt

SEQ ID NO: 3269 - DNA, 9 bp, Artificial Sequence
  Synthetic oligonucleotide
ggcagcgtt

SEQ ID NO: 3270 - DNA, 9 bp, Artificial Sequence
  Synthetic oligonucleotide
agcaccatc

SEQ ID NO: 3271 - DNA, 9 bp, Artificial Sequence
  Synthetic oligonucleotide
atcagagtc

SEQ ID NO: 3272 - DNA, 9 bp, Artificial Sequence
  Synthetic oligonucleotide
agcaccggc

SEQ ID NO: 3273 - DNA, 9 bp, Artificial Sequence
  Synthetic oligonucleotide
ggcagggtc

SEQ ID NO: 3274 - DNA, 9 bp, Artificial Sequence
  Synthetic oligonucleotide
agcaccttc

SEQ ID NO: 3275 - DNA, 9 bp, Artificial Sequence
  Synthetic oligonucleotide
agcggtgtc

SEQ ID NO: 3276 - DNA, 9 bp, Artificial Sequence
  Synthetic oligonucleotide
agcaatgtc

SEQ ID NO: 3277 - DNA, 9 bp, Artificial Sequence
  Synthetic oligonucleotide
agcagggta

SEQ ID NO: 3278 - DNA, 9 bp, Artificial Sequence
  Synthetic oligonucleotide
agcaacgtg

SEQ ID NO: 3279 - DNA, 9 bp, Artificial Sequence
  Synthetic oligonucleotide
agcagggta

SEQ ID NO: 3280 - DNA, 9 bp, Artificial Sequence
  Synthetic oligonucleotide
agcaatgtc

SEQ ID NO: 3281 - DNA, 9 bp, Artificial Sequence
  Synthetic oligonucleotide
agcaatgtc

SEQ ID NO: 3282 - DNA, 9 bp, Artificial Sequence
  Synthetic oligonucleotide
tgcagagtc

SEQ ID NO: 3283 - DNA, 9 bp, Artificial Sequence
  Synthetic oligonucleotide
agcatagtc

SEQ ID NO: 3284 - DNA, 9 bp, Artificial Sequence
  Synthetic oligonucleotide
agcagggta

SEQ ID NO: 3285 - DNA, 9 bp, Artificial Sequence
  Synthetic oligonucleotide
atcaccgtc

SEQ ID NO: 3286 - DNA, 9 bp, Artificial Sequence
  Synthetic oligonucleotide
ggcagcttc

SEQ ID NO: 3287 - DNA, 9 bp, Artificial Sequence
  Synthetic oligonucleotide
agctgggtc

SEQ ID NO: 3288 - DNA, 9 bp, Artificial Sequence
  Synthetic oligonucleotide
agcaacgta

SEQ ID NO: 3289 - DNA, 9 bp, Artificial Sequence
  Synthetic oligonucleotide
agcaaagtc

SEQ ID NO: 3290 - DNA, 9 bp, Artificial Sequence
  Synthetic oligonucleotide
ggcagggtc

SEQ ID NO: 3291 - DNA, 9 bp, Artificial Sequence
  Synthetic oligonucleotide
tgcagggtc

SEQ ID NO: 3292 - DNA, 9 bp, Artificial Sequence
  Synthetic oligonucleotide
agcaaagtc

SEQ ID NO: 3293 - DNA, 9 bp, Artificial Sequence
  Synthetic oligonucleotide
ggcagtgtc

SEQ ID NO: 3294 - DNA, 9 bp, Artificial Sequence
  Synthetic oligonucleotide
agcagctgc

SEQ ID NO: 3295 - DNA, 9 bp, Artificial Sequence
  Synthetic oligonucleotide
agcagcggt

SEQ ID NO: 3296 - DNA, 9 bp, Artificial Sequence
  Synthetic oligonucleotide
agcaacatc

SEQ ID NO: 3297 - DNA, 9 bp, Artificial Sequence
  Synthetic oligonucleotide
agcagtgtg

SEQ ID NO: 3298 - DNA, 9 bp, Artificial Sequence
  Synthetic oligonucleotide
ggcagcttc

SEQ ID NO: 3299 - DNA, 9 bp, Artificial Sequence
  Synthetic oligonucleotide
agcagagtt

SEQ ID NO: 3300 - DNA, 9 bp, Artificial Sequence
  Synthetic oligonucleotide
agcaccttc

SEQ ID NO: 3301 - DNA, 9 bp, Artificial Sequence
  Synthetic oligonucleotide
agcagctgc

SEQ ID NO: 3302 - DNA, 9 bp, Artificial Sequence
  Synthetic oligonucleotide
agtagagtc

SEQ ID NO: 3303 - DNA, 9 bp, Artificial Sequence
  Synthetic oligonucleotide
agcatggtc

SEQ ID NO: 3304 - DNA, 9 bp, Artificial Sequence
  Synthetic oligonucleotide
agcattgtc

SEQ ID NO: 3305 - DNA, 9 bp, Artificial Sequence
  Synthetic oligonucleotide
atcagagtc

SEQ ID NO: 3306 - DNA, 9 bp, Artificial Sequence
  Synthetic oligonucleotide
agcagctta

SEQ ID NO: 3307 - DNA, 9 bp, Artificial Sequence
  Synthetic oligonucleotide
gacagcgtc

SEQ ID NO: 3308 - DNA, 9 bp, Artificial Sequence
  Synthetic oligonucleotide
tgcagagtc

SEQ ID NO: 3309 - DNA, 9 bp, Artificial Sequence
  Synthetic oligonucleotide
agcagagtt

SEQ ID NO: 3310 - DNA, 9 bp, Artificial Sequence
  Synthetic oligonucleotide
agcagggta

SEQ ID NO: 3311 - DNA, 9 bp, Artificial Sequence
  Synthetic oligonucleotide
tgcagtgac

SEQ ID NO: 3312 - DNA, 9 bp, Artificial Sequence
  Synthetic oligonucleotide
agcagaggt

SEQ ID NO: 3313 - DNA, 9 bp, Artificial Sequence
  Synthetic oligonucleotide
agcagttta

SEQ ID NO: 3314 - DNA, 9 bp, Artificial Sequence
  Synthetic oligonucleotide
agaaaggtc

SEQ ID NO: 3315 - DNA, 9 bp, Artificial Sequence
  Synthetic oligonucleotide
agcacaatc

SEQ ID NO: 3316 - DNA, 9 bp, Artificial Sequence
  Synthetic oligonucleotide
agcaaaggc

SEQ ID NO: 3317 - DNA, 9 bp, Artificial Sequence
  Synthetic oligonucleotide
agccacatc

SEQ ID NO: 3318 - DNA, 9 bp, Artificial Sequence
  Synthetic oligonucleotide
tgctgggtc

SEQ ID NO: 3319 - DNA, 9 bp, Artificial Sequence
  Synthetic oligonucleotide
ggcagtgtg

SEQ ID NO: 3320 - DNA, 9 bp, Artificial Sequence
  Synthetic oligonucleotide
agtagtgtg

SEQ ID NO: 3321 - DNA, 9 bp, Artificial Sequence
  Synthetic oligonucleotide
tgcatggtc

SEQ ID NO: 3322 - DNA, 9 bp, Artificial Sequence
  Synthetic oligonucleotide
agcatagtt

SEQ ID NO: 3323 - DNA, 9 bp, Artificial Sequence
  Synthetic oligonucleotide
agcagcagg

SEQ ID NO: 3324 - DNA, 9 bp, Artificial Sequence
  Synthetic oligonucleotide
agcaccatt

SEQ ID NO: 3325 - DNA, 9 bp, Artificial Sequence
  Synthetic oligonucleotide
atcagggtt

SEQ ID NO: 3326 - DNA, 9 bp, Artificial Sequence
  Synthetic oligonucleotide
agcaaagtg

SEQ ID NO: 3327 - DNA, 9 bp, Artificial Sequence
  Synthetic oligonucleotide
agcaacacc

SEQ ID NO: 3328 - DNA, 9 bp, Artificial Sequence
  Synthetic oligonucleotide
ggcagtggc

SEQ ID NO: 3329 - DNA, 9 bp, Artificial Sequence
  Synthetic oligonucleotide
agtatcggc

SEQ ID NO: 3330 - DNA, 9 bp, Artificial Sequence
  Synthetic oligonucleotide
ggcagctcc

SEQ ID NO: 3331 - DNA, 9 bp, Artificial Sequence
  Synthetic oligonucleotide
agcaaaggc

SEQ ID NO: 3332 - DNA, 9 bp, Artificial Sequence
  Synthetic oligonucleotide
agcaagttc

SEQ ID NO: 3333 - DNA, 9 bp, Artificial Sequence
  Synthetic oligonucleotide
agcaaaggc

SEQ ID NO: 3334 - DNA, 9 bp, Artificial Sequence
  Synthetic oligonucleotide
cgcagcaac

SEQ ID NO: 3335 - DNA, 9 bp, Artificial Sequence
  Synthetic oligonucleotide
ggcagcggt

SEQ ID NO: 3336 - DNA, 9 bp, Artificial Sequence
  Synthetic oligonucleotide
agcaactgc

SEQ ID NO: 3337 - DNA, 9 bp, Artificial Sequence
  Synthetic oligonucleotide
agaagagta

SEQ ID NO: 3338 - DNA, 9 bp, Artificial Sequence
  Synthetic oligonucleotide
agcaacata

SEQ ID NO: 3339 - DNA, 9 bp, Artificial Sequence
  Synthetic oligonucleotide
cgcaccttc

SEQ ID NO: 3340 - DNA, 9 bp, Artificial Sequence
  Synthetic oligonucleotide
gtccgcgtc

SEQ ID NO: 3341 - DNA, 9 bp, Artificial Sequence
  Synthetic oligonucleotide
ggcagtgtg

SEQ ID NO: 3342 - DNA, 9 bp, Artificial Sequence
  Synthetic oligonucleotide
cccaccgtc

SEQ ID NO: 3343 - DNA, 9 bp, Artificial Sequence
  Synthetic oligonucleotide
aacaacgtg

SEQ ID NO: 3344 - DNA, 9 bp, Artificial Sequence
  Synthetic oligonucleotide
agcaaccac

SEQ ID NO: 3345 - DNA, 9 bp, Artificial Sequence
  Synthetic oligonucleotide
agccccttc

SEQ ID NO: 3346 - DNA, 9 bp, Artificial Sequence
  Synthetic oligonucleotide
agccgctgc

SEQ ID NO: 3347 - DNA, 9 bp, Artificial Sequence
  Synthetic oligonucleotide
agccgctgc

SEQ ID NO: 3348 - DNA, 9 bp, Artificial Sequence
  Synthetic oligonucleotide
agccgctgc

SEQ ID NO: 3349 - DNA, 9 bp, Artificial Sequence
  Synthetic oligonucleotide
agccgctgc

SEQ ID NO: 3350 - DNA, 9 bp, Artificial Sequence
  Synthetic oligonucleotide
agaggggtc

SEQ ID NO: 3351 - DNA, 9 bp, Artificial Sequence
  Synthetic oligonucleotide
agcaaaggc

SEQ ID NO: 3352 - DNA, 9 bp, Artificial Sequence
  Synthetic oligonucleotide
ggcaacttc

SEQ ID NO: 3353 - DNA, 9 bp, Artificial Sequence
  Synthetic oligonucleotide
gccagcttc

SEQ ID NO: 3354 - DNA, 9 bp, Artificial Sequence
  Synthetic oligonucleotide
agaagggtg

SEQ ID NO: 3355 - DNA, 9 bp, Artificial Sequence
  Synthetic oligonucleotide
agctacgac

SEQ ID NO: 3356 - DNA, 9 bp, Artificial Sequence
  Synthetic oligonucleotide
agcaaggtg

SEQ ID NO: 3357 - DNA, 9 bp, Artificial Sequence
  Synthetic oligonucleotide
aggagagtt

SEQ ID NO: 3358 - DNA, 9 bp, Artificial Sequence
  Synthetic oligonucleotide
tgctccgtc

SEQ ID NO: 3359 - DNA, 9 bp, Artificial Sequence
  Synthetic oligonucleotide
agcactgtt

SEQ ID NO: 3360 - DNA, 9 bp, Artificial Sequence
  Synthetic oligonucleotide
agtaccatc

SEQ ID NO: 3361 - DNA, 9 bp, Artificial Sequence
  Synthetic oligonucleotide
agcagcagg

SEQ ID NO: 3362 - DNA, 9 bp, Artificial Sequence
  Synthetic oligonucleotide
ggcagggac

SEQ ID NO: 3363 - DNA, 9 bp, Artificial Sequence
  Synthetic oligonucleotide
agcaaggtt

SEQ ID NO: 3364 - DNA, 9 bp, Artificial Sequence
  Synthetic oligonucleotide
agcatgggc

SEQ ID NO: 3365 - DNA, 9 bp, Artificial Sequence
  Synthetic oligonucleotide
agctgagta

SEQ ID NO: 3366 - DNA, 9 bp, Artificial Sequence
  Synthetic oligonucleotide
agcgacttc

SEQ ID NO: 3367 - DNA, 9 bp, Artificial Sequence
  Synthetic oligonucleotide
aggagagtt

SEQ ID NO: 3368 - DNA, 9 bp, Artificial Sequence
  Synthetic oligonucleotide
gacagcatc

SEQ ID NO: 3369 - DNA, 9 bp, Artificial Sequence
  Synthetic oligonucleotide
agcaactcc

SEQ ID NO: 3370 - DNA, 9 bp, Artificial Sequence
  Synthetic oligonucleotide
agtcgcttc

SEQ ID NO: 3371 - DNA, 9 bp, Artificial Sequence
  Synthetic oligonucleotide
agtaacatc

SEQ ID NO: 3372 - DNA, 9 bp, Artificial Sequence
  Synthetic oligonucleotide
agcaactgc

SEQ ID NO: 3373 - DNA, 9 bp, Artificial Sequence
  Synthetic oligonucleotide
agcattgtg

SEQ ID NO: 3374 - DNA, 9 bp, Artificial Sequence
  Synthetic oligonucleotide
agaaaagtc

SEQ ID NO: 3375 - DNA, 9 bp, Artificial Sequence
  Synthetic oligonucleotide
ggcagtgta

SEQ ID NO: 3376 - DNA, 9 bp, Artificial Sequence
  Synthetic oligonucleotide
agcaaggta

SEQ ID NO: 3377 - DNA, 9 bp, Artificial Sequence
  Synthetic oligonucleotide
agcatctgc

SEQ ID NO: 3378 - DNA, 9 bp, Artificial Sequence
  Synthetic oligonucleotide
tgcatagtc

SEQ ID NO: 3379 - DNA, 9 bp, Artificial Sequence
  Synthetic oligonucleotide
agaagggtg

SEQ ID NO: 3380 - DNA, 9 bp, Artificial Sequence
  Synthetic oligonucleotide
agccgagtg

SEQ ID NO: 3381 - DNA, 9 bp, Artificial Sequence
  Synthetic oligonucleotide
ctcagggtc

SEQ ID NO: 3382 - DNA, 9 bp, Artificial Sequence
  Synthetic oligonucleotide
aacagggtt

SEQ ID NO: 3383 - DNA, 9 bp, Artificial Sequence
  Synthetic oligonucleotide
agcctagtc

SEQ ID NO: 3384 - DNA, 9 bp, Artificial Sequence
  Synthetic oligonucleotide
agcaatgtt

SEQ ID NO: 3385 - DNA, 9 bp, Artificial Sequence
  Synthetic oligonucleotide
agcagcaaa

SEQ ID NO: 3386 - DNA, 9 bp, Artificial Sequence
  Synthetic oligonucleotide
agcagtccc

SEQ ID NO: 3387 - DNA, 9 bp, Artificial Sequence
  Synthetic oligonucleotide
tgcaatgtc

SEQ ID NO: 3388 - DNA, 9 bp, Artificial Sequence
  Synthetic oligonucleotide
tgcaggttc

SEQ ID NO: 3389 - DNA, 9 bp, Artificial Sequence
  Synthetic oligonucleotide
agctaagtc

SEQ ID NO: 3390 - DNA, 9 bp, Artificial Sequence
  Synthetic oligonucleotide
agcatagtt

SEQ ID NO: 3391 - DNA, 9 bp, Artificial Sequence
  Synthetic oligonucleotide
agcatggta

SEQ ID NO: 3392 - DNA, 9 bp, Artificial Sequence
  Synthetic oligonucleotide
agcaaggac

SEQ ID NO: 3393 - DNA, 9 bp, Artificial Sequence
  Synthetic oligonucleotide
aggtgggtc

SEQ ID NO: 3394 - DNA, 9 bp, Artificial Sequence
  Synthetic oligonucleotide
agcagctgt

SEQ ID NO: 3395 - DNA, 9 bp, Artificial Sequence
  Synthetic oligonucleotide
tgcatggtc

SEQ ID NO: 3396 - DNA, 9 bp, Artificial Sequence
  Synthetic oligonucleotide
agcatagta

SEQ ID NO: 3397 - DNA, 9 bp, Artificial Sequence
  Synthetic oligonucleotide
agcaaggta

SEQ ID NO: 3398 - DNA, 9 bp, Artificial Sequence
  Synthetic oligonucleotide
tgcaccttc

SEQ ID NO: 3399 - DNA, 9 bp, Artificial Sequence
  Synthetic oligonucleotide
agcaccgag

SEQ ID NO: 3400 - DNA, 9 bp, Artificial Sequence
  Synthetic oligonucleotide
tggagagtc

SEQ ID NO: 3401 - DNA, 9 bp, Artificial Sequence
  Synthetic oligonucleotide
agaagagtt

SEQ ID NO: 3402 - DNA, 9 bp, Artificial Sequence
  Synthetic oligonucleotide
atcagggtt

SEQ ID NO: 3403 - DNA, 9 bp, Artificial Sequence
  Synthetic oligonucleotide
ggcagtgcc

SEQ ID NO: 3404 - DNA, 9 bp, Artificial Sequence
  Synthetic oligonucleotide
agtaaggtc

SEQ ID NO: 3405 - DNA, 9 bp, Artificial Sequence
  Synthetic oligonucleotide
agcagcagg

SEQ ID NO: 3406 - DNA, 9 bp, Artificial Sequence
  Synthetic oligonucleotide
agccatgtg

SEQ ID NO: 3407 - DNA, 9 bp, Artificial Sequence
  Synthetic oligonucleotide
ggtagtgtt

SEQ ID NO: 3408 - DNA, 9 bp, Artificial Sequence
  Synthetic oligonucleotide
tacaaagtc

SEQ ID NO: 3409 - DNA, 9 bp, Artificial Sequence
  Synthetic oligonucleotide
agccatgta

SEQ ID NO: 3410 - DNA, 9 bp, Artificial Sequence
  Synthetic oligonucleotide
gactgggtc

SEQ ID NO: 3411 - DNA, 9 bp, Artificial Sequence
  Synthetic oligonucleotide
agcacagca

SEQ ID NO: 3412 - DNA, 9 bp, Artificial Sequence
  Synthetic oligonucleotide
tgaatagtc

SEQ ID NO: 3413 - DNA, 9 bp, Artificial Sequence
  Synthetic oligonucleotide
gtcaggttc

SEQ ID NO: 3414 - DNA, 9 bp, Artificial Sequence
  Synthetic oligonucleotide
ggtaaagtc

SEQ ID NO: 3415 - DNA, 9 bp, Artificial Sequence
  Synthetic oligonucleotide
agtatagtg

SEQ ID NO: 3416 - DNA, 9 bp, Artificial Sequence
  Synthetic oligonucleotide
atgggggtc

SEQ ID NO: 3417 - DNA, 9 bp, Artificial Sequence
  Synthetic oligonucleotide
cccaaagtc

SEQ ID NO: 3418 - DNA, 9 bp, Artificial Sequence
  Synthetic oligonucleotide
caaatcgtc

SEQ ID NO: 3419 - DNA, 9 bp, Artificial Sequence
  Synthetic oligonucleotide
aataaggtc

SEQ ID NO: 3420 - DNA, 9 bp, Artificial Sequence
  Synthetic oligonucleotide
agtatagtt

SEQ ID NO: 3421 - DNA, 9 bp, Artificial Sequence
  Synthetic oligonucleotide
agagaggtc

SEQ ID NO: 3422 - DNA, 9 bp, Artificial Sequence
  Synthetic oligonucleotide
tggtgagtc

SEQ ID NO: 3423 - DNA, 9 bp, Artificial Sequence
  Synthetic oligonucleotide
tgcctggtc

SEQ ID NO: 3424 - DNA, 9 bp, Artificial Sequence
  Synthetic oligonucleotide
agccatgtg

SEQ ID NO: 3425 - DNA, 9 bp, Artificial Sequence
  Synthetic oligonucleotide
aacaaggtt

SEQ ID NO: 3426 - DNA, 9 bp, Artificial Sequence
  Synthetic oligonucleotide
agcaattta

SEQ ID NO: 3427 - DNA, 9 bp, Artificial Sequence
  Synthetic oligonucleotide
aggcatgtc

SEQ ID NO: 3428 - DNA, 9 bp, Artificial Sequence
  Synthetic oligonucleotide
tacaaagtc

SEQ ID NO: 3429 - DNA, 9 bp, Artificial Sequence
  Synthetic oligonucleotide
aataaggtc

SEQ ID NO: 3430 - DNA, 9 bp, Artificial Sequence
  Synthetic oligonucleotide
aataaagtc

SEQ ID NO: 3431 - DNA, 9 bp, Artificial Sequence
  Synthetic oligonucleotide
aataaggtc

SEQ ID NO: 3432 - DNA, 9 bp, Artificial Sequence
  Synthetic oligonucleotide
aataaggtc

SEQ ID NO: 3433 - DNA, 9 bp, Artificial Sequence
  Synthetic oligonucleotide
aataaggtc

SEQ ID NO: 3434 - DNA, 9 bp, Artificial Sequence
  Synthetic oligonucleotide
aataaggtc

SEQ ID NO: 3435 - DNA, 9 bp, Artificial Sequence
  Synthetic oligonucleotide
agcacagca

SEQ ID NO: 3436 - DNA, 9 bp, Artificial Sequence
  Synthetic oligonucleotide
ggaaaggtc

SEQ ID NO: 3437 - DNA, 9 bp, Artificial Sequence
  Synthetic oligonucleotide
agccatttc

SEQ ID NO: 3438 - DNA, 9 bp, Artificial Sequence
  Synthetic oligonucleotide
aataaggtc

SEQ ID NO: 3439 - DNA, 9 bp, Artificial Sequence
  Synthetic oligonucleotide
atcagcact

SEQ ID NO: 3440 - DNA, 9 bp, Artificial Sequence
  Synthetic oligonucleotide
ggtggggtc

SEQ ID NO: 3441 - DNA, 9 bp, Artificial Sequence
  Synthetic oligonucleotide
cacacagtc

SEQ ID NO: 3442 - DNA, 9 bp, Artificial Sequence
  Synthetic oligonucleotide
aatattgtc

SEQ ID NO: 3443 - DNA, 9 bp, Artificial Sequence
  Synthetic oligonucleotide
ggaatagtc

SEQ ID NO: 3444 - DNA, 9 bp, Artificial Sequence
  Synthetic oligonucleotide
agcaacaat

SEQ ID NO: 3445 - DNA, 9 bp, Artificial Sequence
  Synthetic oligonucleotide
aataaggtc

SEQ ID NO: 3446 - DNA, 9 bp, Artificial Sequence
  Synthetic oligonucleotide
gactgtgtc

SEQ ID NO: 3447 - DNA, 9 bp, Artificial Sequence
  Synthetic oligonucleotide
aataaagtc

SEQ ID NO: 3448 - DNA, 9 bp, Artificial Sequence
  Synthetic oligonucleotide
aataaggtc

SEQ ID NO: 3449 - DNA, 9 bp, Artificial Sequence
  Synthetic oligonucleotide
aataaggtc

SEQ ID NO: 3450 - DNA, 9 bp, Artificial Sequence
  Synthetic oligonucleotide
aataaggtc

SEQ ID NO: 3451 - DNA, 9 bp, Artificial Sequence
  Synthetic oligonucleotide
aataaggtc

SEQ ID NO: 3452 - DNA, 9 bp, Artificial Sequence
  Synthetic oligonucleotide
agcagcttc

SEQ ID NO: 3453 - DNA, 9 bp, Artificial Sequence
  Synthetic oligonucleotide
ggcaacgtc

SEQ ID NO: 3454 - DNA, 9 bp, Artificial Sequence
  Synthetic oligonucleotide
agcagtttc

SEQ ID NO: 3455 - DNA, 9 bp, Artificial Sequence
  Synthetic oligonucleotide
agcagtttc

SEQ ID NO: 3456 - DNA, 9 bp, Artificial Sequence
  Synthetic oligonucleotide
agcagcagc

SEQ ID NO: 3457 - DNA, 9 bp, Artificial Sequence
  Synthetic oligonucleotide
agcagcagc

SEQ ID NO: 3458 - DNA, 9 bp, Artificial Sequence
  Synthetic oligonucleotide
agcaacttc

SEQ ID NO: 3459 - DNA, 9 bp, Artificial Sequence
  Synthetic oligonucleotide
agcaacttc

SEQ ID NO: 3460 - DNA, 9 bp, Artificial Sequence
  Synthetic oligonucleotide
agcaaggtc

SEQ ID NO: 3461 - DNA, 9 bp, Artificial Sequence
  Synthetic oligonucleotide
agcagtttc

SEQ ID NO: 3462 - DNA, 9 bp, Artificial Sequence
  Synthetic oligonucleotide
agcagcagc

SEQ ID NO: 3463 - DNA, 9 bp, Artificial Sequence
  Synthetic oligonucleotide
agcattgtc

SEQ ID NO: 3464 - DNA, 9 bp, Artificial Sequence
  Synthetic oligonucleotide
agcccagtc

SEQ ID NO: 3465 - DNA, 9 bp, Artificial Sequence
  Synthetic oligonucleotide
agctacatc

SEQ ID NO: 3466 - DNA, 9 bp, Artificial Sequence
  Synthetic oligonucleotide
agcatggtt

SEQ ID NO: 3467 - DNA, 9 bp, Artificial Sequence
  Synthetic oligonucleotide
gacagggtc

SEQ ID NO: 3468 - DNA, 9 bp, Artificial Sequence
  Synthetic oligonucleotide
atcctcgtc

SEQ ID NO: 3469 - DNA, 9 bp, Artificial Sequence
  Synthetic oligonucleotide
cagagcgtc

SEQ ID NO: 3470 - DNA, 9 bp, Artificial Sequence
  Synthetic oligonucleotide
agcaaaggc

SEQ ID NO: 3471 - DNA, 9 bp, Artificial Sequence
  Synthetic oligonucleotide
agcatcgat

SEQ ID NO: 3472 - DNA, 9 bp, Artificial Sequence
  Synthetic oligonucleotide
atcatggtc

SEQ ID NO: 3473 - DNA, 9 bp, Artificial Sequence
  Synthetic oligonucleotide
agcccagtc

SEQ ID NO: 3474 - DNA, 9 bp, Artificial Sequence
  Synthetic oligonucleotide
tgcatagtc

SEQ ID NO: 3475 - DNA, 9 bp, Artificial Sequence
  Synthetic oligonucleotide
agccatgtc

SEQ ID NO: 3476 - DNA, 9 bp, Artificial Sequence
  Synthetic oligonucleotide
agcattgta

SEQ ID NO: 3477 - DNA, 9 bp, Artificial Sequence
  Synthetic oligonucleotide
atcatggtc

SEQ ID NO: 3478 - DNA, 9 bp, Artificial Sequence
  Synthetic oligonucleotide
agcaaaggc

SEQ ID NO: 3479 - DNA, 9 bp, Artificial Sequence
  Synthetic oligonucleotide
ataagagtc

SEQ ID NO: 3480 - DNA, 9 bp, Artificial Sequence
  Synthetic oligonucleotide
agccatgtc

SEQ ID NO: 3481 - DNA, 9 bp, Artificial Sequence
  Synthetic oligonucleotide
agcaaaggc

SEQ ID NO: 3482 - DNA, 9 bp, Artificial Sequence
  Synthetic oligonucleotide
agcccagtc

SEQ ID NO: 3483 - DNA, 9 bp, Artificial Sequence
  Synthetic oligonucleotide
ttccacgtc

SEQ ID NO: 3484 - DNA, 9 bp, Artificial Sequence
  Synthetic oligonucleotide
agtcaggtc

SEQ ID NO: 3485 - DNA, 9 bp, Artificial Sequence
  Synthetic oligonucleotide
ctgagggtc

SEQ ID NO: 3486 - DNA, 9 bp, Artificial Sequence
  Synthetic oligonucleotide
atgacagtc

SEQ ID NO: 3487 - DNA, 9 bp, Artificial Sequence
  Synthetic oligonucleotide
aacagtcta

SEQ ID NO: 3488 - DNA, 9 bp, Artificial Sequence
  Synthetic oligonucleotide
ctcagtttc

SEQ ID NO: 3489 - DNA, 9 bp, Artificial Sequence
  Synthetic oligonucleotide
agtcaggtc

SEQ ID NO: 3490 - DNA, 9 bp, Artificial Sequence
  Synthetic oligonucleotide
gtgggcgtc

SEQ ID NO: 3491 - DNA, 9 bp, Artificial Sequence
  Synthetic oligonucleotide
ggtggggtc

SEQ ID NO: 3492 - DNA, 9 bp, Artificial Sequence
  Synthetic oligonucleotide
agttaagtc

SEQ ID NO: 3493 - DNA, 9 bp, Artificial Sequence
  Synthetic oligonucleotide
ttcaccttc

SEQ ID NO: 3494 - DNA, 9 bp, Artificial Sequence
  Synthetic oligonucleotide
tcctgagtc

SEQ ID NO: 3495 - DNA, 9 bp, Artificial Sequence
  Synthetic oligonucleotide
ataatagtc

SEQ ID NO: 3496 - DNA, 9 bp, Artificial Sequence
  Synthetic oligonucleotide
agcaaaggt

SEQ ID NO: 3497 - DNA, 9 bp, Artificial Sequence
  Synthetic oligonucleotide
agtttagtc

SEQ ID NO: 3498 - DNA, 9 bp, Artificial Sequence
  Synthetic oligonucleotide
acaaaggtc

SEQ ID NO: 3499 - DNA, 9 bp, Artificial Sequence
  Synthetic oligonucleotide
tgcagtccc

SEQ ID NO: 3500 - DNA, 9 bp, Artificial Sequence
  Synthetic oligonucleotide
agtcatgtc

SEQ ID NO: 3501 - DNA, 9 bp, Artificial Sequence
  Synthetic oligonucleotide
caccacgtc

SEQ ID NO: 3502 - DNA, 9 bp, Artificial Sequence
  Synthetic oligonucleotide
ctcagtttc

SEQ ID NO: 3503 - DNA, 9 bp, Artificial Sequence
  Synthetic oligonucleotide
gaaagtgtc

SEQ ID NO: 3504 - DNA, 9 bp, Artificial Sequence
  Synthetic oligonucleotide
gggtgggtc

SEQ ID NO: 3505 - DNA, 9 bp, Artificial Sequence
  Synthetic oligonucleotide
agagttgtc

SEQ ID NO: 3506 - DNA, 9 bp, Artificial Sequence
  Synthetic oligonucleotide
agaaggggt

SEQ ID NO: 3507 - DNA, 9 bp, Artificial Sequence
  Synthetic oligonucleotide
agcagagtc

SEQ ID NO: 3508 - DNA, 9 bp, Artificial Sequence
  Synthetic oligonucleotide
accatcttc

SEQ ID NO: 3509 - DNA, 9 bp, Artificial Sequence
  Synthetic oligonucleotide
aggaacgtc

SEQ ID NO: 3510 - DNA, 9 bp, Artificial Sequence
  Synthetic oligonucleotide
agcaccttc

SEQ ID NO: 3511 - DNA, 9 bp, Artificial Sequence
  Synthetic oligonucleotide
ggcagggtc

SEQ ID NO: 3512 - DNA, 9 bp, Artificial Sequence
  Synthetic oligonucleotide
ggcagggtc

SEQ ID NO: 3513 - DNA, 9 bp, Artificial Sequence
  Synthetic oligonucleotide
agcacagtc

SEQ ID NO: 3514 - DNA, 9 bp, Artificial Sequence
  Synthetic oligonucleotide
ggcagggtc

SEQ ID NO: 3515 - DNA, 9 bp, Artificial Sequence
  Synthetic oligonucleotide
agcaaggtc

SEQ ID NO: 3516 - DNA, 9 bp, Artificial Sequence
  Synthetic oligonucleotide
agcaagttc

SEQ ID NO: 3517 - DNA, 9 bp, Artificial Sequence
  Synthetic oligonucleotide
agcagtttt

SEQ ID NO: 3518 - DNA, 9 bp, Artificial Sequence
  Synthetic oligonucleotide
agctgcgtc

SEQ ID NO: 3519 - DNA, 9 bp, Artificial Sequence
  Synthetic oligonucleotide
agcagggtc

SEQ ID NO: 3520 - DNA, 9 bp, Artificial Sequence
  Synthetic oligonucleotide
agcagggtc

SEQ ID NO: 3521 - DNA, 9 bp, Artificial Sequence
  Synthetic oligonucleotide
agaagcctc

SEQ ID NO: 3522 - DNA, 9 bp, Artificial Sequence
  Synthetic oligonucleotide
agaagcctc

SEQ ID NO: 3523 - DNA, 9 bp, Artificial Sequence
  Synthetic oligonucleotide
agcattttc

SEQ ID NO: 3524 - DNA, 9 bp, Artificial Sequence
  Synthetic oligonucleotide
agcagcgtc

SEQ ID NO: 3525 - DNA, 9 bp, Artificial Sequence
  Synthetic oligonucleotide
agcagtgtc

SEQ ID NO: 3526 - DNA, 9 bp, Artificial Sequence
  Synthetic oligonucleotide
agcagtgtc

SEQ ID NO: 3527 - DNA, 9 bp, Artificial Sequence
  Synthetic oligonucleotide
agcaacttc

SEQ ID NO: 3528 - DNA, 9 bp, Artificial Sequence
  Synthetic oligonucleotide
agcccggtc

SEQ ID NO: 3529 - DNA, 9 bp, Artificial Sequence
  Synthetic oligonucleotide
agtaacttc

SEQ ID NO: 3530 - DNA, 9 bp, Artificial Sequence
  Synthetic oligonucleotide
agtaacttc

SEQ ID NO: 3531 - DNA, 9 bp, Artificial Sequence
  Synthetic oligonucleotide
acctgcttc

SEQ ID NO: 3532 - DNA, 9 bp, Artificial Sequence
  Synthetic oligonucleotide
agcattttc

SEQ ID NO: 3533 - DNA, 9 bp, Artificial Sequence
  Synthetic oligonucleotide
agtaacttc

SEQ ID NO: 3534 - DNA, 9 bp, Artificial Sequence
  Synthetic oligonucleotide
agcaatgtt

SEQ ID NO: 3535 - DNA, 9 bp, Artificial Sequence
  Synthetic oligonucleotide
agcattttc

SEQ ID NO: 3536 - DNA, 9 bp, Artificial Sequence
  Synthetic oligonucleotide
agccacggc

SEQ ID NO: 3537 - DNA, 9 bp, Artificial Sequence
  Synthetic oligonucleotide
cctagagtc

SEQ ID NO: 3538 - DNA, 9 bp, Artificial Sequence
  Synthetic oligonucleotide
atcatagtg

SEQ ID NO: 3539 - DNA, 9 bp, Artificial Sequence
  Synthetic oligonucleotide
gagtgagaa

SEQ ID NO: 3540 - DNA, 9 bp, Artificial Sequence
  Synthetic oligonucleotide
cagtgagga

SEQ ID NO: 3541 - DNA, 9 bp, Artificial Sequence
  Synthetic oligonucleotide
gattgagga

SEQ ID NO: 3542 - DNA, 9 bp, Artificial Sequence
  Synthetic oligonucleotide
gagtgagga

SEQ ID NO: 3543 - DNA, 9 bp, Artificial Sequence
  Synthetic oligonucleotide
gagtgagga

SEQ ID NO: 3544 - DNA, 9 bp, Artificial Sequence
  Synthetic oligonucleotide
gagtgagga

SEQ ID NO: 3545 - DNA, 9 bp, Artificial Sequence
  Synthetic oligonucleotide
gagtgagga

SEQ ID NO: 3546 - DNA, 9 bp, Artificial Sequence
  Synthetic oligonucleotide
gagtgagga

SEQ ID NO: 3547 - DNA, 9 bp, Artificial Sequence
  Synthetic oligonucleotide
gagtgagga

SEQ ID NO: 3548 - DNA, 9 bp, Artificial Sequence
  Synthetic oligonucleotide
gagtgagga

SEQ ID NO: 3549 - DNA, 9 bp, Artificial Sequence
  Synthetic oligonucleotide
gagtgagga

SEQ ID NO: 3550 - DNA, 9 bp, Artificial Sequence
  Synthetic oligonucleotide
gagtgagga

SEQ ID NO: 3551 - DNA, 9 bp, Artificial Sequence
  Synthetic oligonucleotide
gagtgagga

SEQ ID NO: 3552 - DNA, 9 bp, Artificial Sequence
  Synthetic oligonucleotide
gagtgagga

SEQ ID NO: 3553 - DNA, 9 bp, Artificial Sequence
  Synthetic oligonucleotide
gagtgagga

SEQ ID NO: 3554 - DNA, 9 bp, Artificial Sequence
  Synthetic oligonucleotide
gagtgagga

SEQ ID NO: 3555 - DNA, 9 bp, Artificial Sequence
  Synthetic oligonucleotide
gagtgagga

SEQ ID NO: 3556 - DNA, 9 bp, Artificial Sequence
  Synthetic oligonucleotide
gagtgagga

SEQ ID NO: 3557 - DNA, 9 bp, Artificial Sequence
  Synthetic oligonucleotide
gagtgagga

SEQ ID NO: 3558 - DNA, 9 bp, Artificial Sequence
  Synthetic oligonucleotide
gagtgagga

SEQ ID NO: 3559 - DNA, 9 bp, Artificial Sequence
  Synthetic oligonucleotide
gagtgagga

SEQ ID NO: 3560 - DNA, 9 bp, Artificial Sequence
  Synthetic oligonucleotide
gagtgagga

SEQ ID NO: 3561 - DNA, 9 bp, Artificial Sequence
  Synthetic oligonucleotide
gagtgagga

SEQ ID NO: 3562 - DNA, 9 bp, Artificial Sequence
  Synthetic oligonucleotide
gagtgagga

SEQ ID NO: 3563 - DNA, 9 bp, Artificial Sequence
  Synthetic oligonucleotide
gagtgagga

SEQ ID NO: 3564 - DNA, 9 bp, Artificial Sequence
  Synthetic oligonucleotide
gagtgagga

SEQ ID NO: 3565 - DNA, 9 bp, Artificial Sequence
  Synthetic oligonucleotide
gagtgagga

SEQ ID NO: 3566 - DNA, 9 bp, Artificial Sequence
  Synthetic oligonucleotide
gagtgagga

SEQ ID NO: 3567 - DNA, 9 bp, Artificial Sequence
  Synthetic oligonucleotide
gagtgagga

SEQ ID NO: 3568 - DNA, 9 bp, Artificial Sequence
  Synthetic oligonucleotide
gggtgaggt

SEQ ID NO: 3569 - DNA, 9 bp, Artificial Sequence
  Synthetic oligonucleotide
gagtgttga

SEQ ID NO: 3570 - DNA, 9 bp, Artificial Sequence
  Synthetic oligonucleotide
cagtgaggc

SEQ ID NO: 3571 - DNA, 9 bp, Artificial Sequence
  Synthetic oligonucleotide
cagtgaggc

SEQ ID NO: 3572 - DNA, 9 bp, Artificial Sequence
  Synthetic oligonucleotide
gagtgagat

SEQ ID NO: 3573 - DNA, 9 bp, Artificial Sequence
  Synthetic oligonucleotide
gtgtgagaa

SEQ ID NO: 3574 - DNA, 9 bp, Artificial Sequence
  Synthetic oligonucleotide
gagtgaggg

SEQ ID NO: 3575 - DNA, 9 bp, Artificial Sequence
  Synthetic oligonucleotide
gagtgaggc

SEQ ID NO: 3576 - DNA, 9 bp, Artificial Sequence
  Synthetic oligonucleotide
gagtgaggg

SEQ ID NO: 3577 - DNA, 9 bp, Artificial Sequence
  Synthetic oligonucleotide
gagtgaggc

SEQ ID NO: 3578 - DNA, 9 bp, Artificial Sequence
  Synthetic oligonucleotide
gagtgaggc

SEQ ID NO: 3579 - DNA, 9 bp, Artificial Sequence
  Synthetic oligonucleotide
gagtgaggg

SEQ ID NO: 3580 - DNA, 9 bp, Artificial Sequence
  Synthetic oligonucleotide
gagtgaggc

SEQ ID NO: 3581 - DNA, 9 bp, Artificial Sequence
  Synthetic oligonucleotide
gagtgaggg

SEQ ID NO: 3582 - DNA, 9 bp, Artificial Sequence
  Synthetic oligonucleotide
gagtgaggg

SEQ ID NO: 3583 - DNA, 9 bp, Artificial Sequence
  Synthetic oligonucleotide
gagtgaggt

SEQ ID NO: 3584 - DNA, 9 bp, Artificial Sequence
  Synthetic oligonucleotide
gagtgaggt

SEQ ID NO: 3585 - DNA, 9 bp, Artificial Sequence
  Synthetic oligonucleotide
gagtgaggg

SEQ ID NO: 3586 - DNA, 9 bp, Artificial Sequence
  Synthetic oligonucleotide
gagtgaggg

SEQ ID NO: 3587 - DNA, 9 bp, Artificial Sequence
  Synthetic oligonucleotide
gagtgaggc

SEQ ID NO: 3588 - DNA, 9 bp, Artificial Sequence
  Synthetic oligonucleotide
gagtgaggc

SEQ ID NO: 3589 - DNA, 9 bp, Artificial Sequence
  Synthetic oligonucleotide
gagtgaggg

SEQ ID NO: 3590 - DNA, 9 bp, Artificial Sequence
  Synthetic oligonucleotide
gagtgaggg

SEQ ID NO: 3591 - DNA, 9 bp, Artificial Sequence
  Synthetic oligonucleotide
gagtgaggg

SEQ ID NO: 3592 - DNA, 9 bp, Artificial Sequence
  Synthetic oligonucleotide
gagtgaggt

SEQ ID NO: 3593 - DNA, 9 bp, Artificial Sequence
  Synthetic oligonucleotide
gagtgaggc

SEQ ID NO: 3594 - DNA, 9 bp, Artificial Sequence
  Synthetic oligonucleotide
gagtgaggt

SEQ ID NO: 3595 - DNA, 9 bp, Artificial Sequence
  Synthetic oligonucleotide
gagtgaggc

SEQ ID NO: 3596 - DNA, 9 bp, Artificial Sequence
  Synthetic oligonucleotide
gagtgaggc

SEQ ID NO: 3597 - DNA, 9 bp, Artificial Sequence
  Synthetic oligonucleotide
gagtgagga

SEQ ID NO: 3598 - DNA, 9 bp, Artificial Sequence
  Synthetic oligonucleotide
gagtgagga

SEQ ID NO: 3599 - DNA, 9 bp, Artificial Sequence
  Synthetic oligonucleotide
gagtgagga

SEQ ID NO: 3600 - DNA, 9 bp, Artificial Sequence
  Synthetic oligonucleotide
gagtgaggt

SEQ ID NO: 3601 - DNA, 9 bp, Artificial Sequence
  Synthetic oligonucleotide
cagagagga

SEQ ID NO: 3602 - DNA, 9 bp, Artificial Sequence
  Synthetic oligonucleotide
gagtgagca

SEQ ID NO: 3603 - DNA, 9 bp, Artificial Sequence
  Synthetic oligonucleotide
gagtgagaa

SEQ ID NO: 3604 - DNA, 9 bp, Artificial Sequence
  Synthetic oligonucleotide
gagagagga

SEQ ID NO: 3605 - DNA, 9 bp, Artificial Sequence
  Synthetic oligonucleotide
gagtgagta

SEQ ID NO: 3606 - DNA, 9 bp, Artificial Sequence
  Synthetic oligonucleotide
cagtgagga

SEQ ID NO: 3607 - DNA, 9 bp, Artificial Sequence
  Synthetic oligonucleotide
aagtgagga

SEQ ID NO: 3608 - DNA, 9 bp, Artificial Sequence
  Synthetic oligonucleotide
gagtgagca

SEQ ID NO: 3609 - DNA, 9 bp, Artificial Sequence
  Synthetic oligonucleotide
gagtgagta

SEQ ID NO: 3610 - DNA, 9 bp, Artificial Sequence
  Synthetic oligonucleotide
gagtgggga

SEQ ID NO: 3611 - DNA, 9 bp, Artificial Sequence
  Synthetic oligonucleotide
gaatgagga

SEQ ID NO: 3612 - DNA, 9 bp, Artificial Sequence
  Synthetic oligonucleotide
aagtgagga

SEQ ID NO: 3613 - DNA, 9 bp, Artificial Sequence
  Synthetic oligonucleotide
aagtgagga

SEQ ID NO: 3614 - DNA, 9 bp, Artificial Sequence
  Synthetic oligonucleotide
gagtgatga

SEQ ID NO: 3615 - DNA, 9 bp, Artificial Sequence
  Synthetic oligonucleotide
gagtgagca

SEQ ID NO: 3616 - DNA, 9 bp, Artificial Sequence
  Synthetic oligonucleotide
gagtgagga

SEQ ID NO: 3617 - DNA, 9 bp, Artificial Sequence
  Synthetic oligonucleotide
gagtgagga

SEQ ID NO: 3618 - DNA, 9 bp, Artificial Sequence
  Synthetic oligonucleotide
gagtgagga

SEQ ID NO: 3619 - DNA, 9 bp, Artificial Sequence
  Synthetic oligonucleotide
gagtgagga

SEQ ID NO: 3620 - DNA, 9 bp, Artificial Sequence
  Synthetic oligonucleotide
gagtgagga

SEQ ID NO: 3621 - DNA, 9 bp, Artificial Sequence
  Synthetic oligonucleotide
gagtgagga

SEQ ID NO: 3622 - DNA, 9 bp, Artificial Sequence
  Synthetic oligonucleotide
gagtgagga

SEQ ID NO: 3623 - DNA, 9 bp, Artificial Sequence
  Synthetic oligonucleotide
gagtgagga

SEQ ID NO: 3624 - DNA, 9 bp, Artificial Sequence
  Synthetic oligonucleotide
gagtgagga

SEQ ID NO: 3625 - DNA, 9 bp, Artificial Sequence
  Synthetic oligonucleotide
gagtgagga

SEQ ID NO: 3626 - DNA, 9 bp, Artificial Sequence
  Synthetic oligonucleotide
tagggaggg

SEQ ID NO: 3627 - DNA, 9 bp, Artificial Sequence
  Synthetic oligonucleotide
atgtgaggc

SEQ ID NO: 3628 - DNA, 9 bp, Artificial Sequence
  Synthetic oligonucleotide
gtgtggggc

SEQ ID NO: 3629 - DNA, 9 bp, Artificial Sequence
  Synthetic oligonucleotide
gaggggggt

SEQ ID NO: 3630 - DNA, 9 bp, Artificial Sequence
  Synthetic oligonucleotide
gtgtggggc

SEQ ID NO: 3631 - DNA, 9 bp, Artificial Sequence
  Synthetic oligonucleotide
tagagaggt

SEQ ID NO: 3632 - DNA, 9 bp, Artificial Sequence
  Synthetic oligonucleotide
gagtgtgaa

SEQ ID NO: 3633 - DNA, 9 bp, Artificial Sequence
  Synthetic oligonucleotide
cagtgaggg

SEQ ID NO: 3634 - DNA, 9 bp, Artificial Sequence
  Synthetic oligonucleotide
gagtggggg

SEQ ID NO: 3635 - DNA, 9 bp, Artificial Sequence
  Synthetic oligonucleotide
cagtgaggc

SEQ ID NO: 3636 - DNA, 9 bp, Artificial Sequence
  Synthetic oligonucleotide
gagtggggg

SEQ ID NO: 3637 - DNA, 9 bp, Artificial Sequence
  Synthetic oligonucleotide
gagtgaagg

SEQ ID NO: 3638 - DNA, 9 bp, Artificial Sequence
  Synthetic oligonucleotide
gagttaggt

SEQ ID NO: 3639 - DNA, 9 bp, Artificial Sequence
  Synthetic oligonucleotide
cagtgaggc

SEQ ID NO: 3640 - DNA, 9 bp, Artificial Sequence
  Synthetic oligonucleotide
gagggaggc

SEQ ID NO: 3641 - DNA, 9 bp, Artificial Sequence
  Synthetic oligonucleotide
gagtgagac

SEQ ID NO: 3642 - DNA, 9 bp, Artificial Sequence
  Synthetic oligonucleotide
gtgtgaggc

SEQ ID NO: 3643 - DNA, 9 bp, Artificial Sequence
  Synthetic oligonucleotide
gagggaggg

SEQ ID NO: 3644 - DNA, 9 bp, Artificial Sequence
  Synthetic oligonucleotide
gagagaggt

SEQ ID NO: 3645 - DNA, 9 bp, Artificial Sequence
  Synthetic oligonucleotide
gagttaggt

SEQ ID NO: 3646 - DNA, 9 bp, Artificial Sequence
  Synthetic oligonucleotide
gagtggggg

SEQ ID NO: 3647 - DNA, 9 bp, Artificial Sequence
  Synthetic oligonucleotide
gagggaggt

SEQ ID NO: 3648 - DNA, 9 bp, Artificial Sequence
  Synthetic oligonucleotide
gagggaggg

SEQ ID NO: 3649 - DNA, 9 bp, Artificial Sequence
  Synthetic oligonucleotide
gagggaggg

SEQ ID NO: 3650 - DNA, 9 bp, Artificial Sequence
  Synthetic oligonucleotide
gagggaggt

SEQ ID NO: 3651 - DNA, 9 bp, Artificial Sequence
  Synthetic oligonucleotide
gagtgggca

SEQ ID NO: 3652 - DNA, 9 bp, Artificial Sequence
  Synthetic oligonucleotide
tagtgagga

SEQ ID NO: 3653 - DNA, 9 bp, Artificial Sequence
  Synthetic oligonucleotide
gagtgaggt

SEQ ID NO: 3654 - DNA, 9 bp, Artificial Sequence
  Synthetic oligonucleotide
gagtgaggc

SEQ ID NO: 3655 - DNA, 9 bp, Artificial Sequence
  Synthetic oligonucleotide
gagtgaggg

SEQ ID NO: 3656 - DNA, 9 bp, Artificial Sequence
  Synthetic oligonucleotide
gagtgaggg

SEQ ID NO: 3657 - DNA, 9 bp, Artificial Sequence
  Synthetic oligonucleotide
gagtgaggg

SEQ ID NO: 3658 - DNA, 9 bp, Artificial Sequence
  Synthetic oligonucleotide
gagtgaggg

SEQ ID NO: 3659 - DNA, 9 bp, Artificial Sequence
  Synthetic oligonucleotide
gagtgaggg

SEQ ID NO: 3660 - DNA, 9 bp, Artificial Sequence
  Synthetic oligonucleotide
gagtgaggc

SEQ ID NO: 3661 - DNA, 9 bp, Artificial Sequence
  Synthetic oligonucleotide
gagtgaggg

SEQ ID NO: 3662 - DNA, 9 bp, Artificial Sequence
  Synthetic oligonucleotide
gagtgaggt

SEQ ID NO: 3663 - DNA, 9 bp, Artificial Sequence
  Synthetic oligonucleotide
gagtgaggg

SEQ ID NO: 3664 - DNA, 9 bp, Artificial Sequence
  Synthetic oligonucleotide
gagtgaggt

SEQ ID NO: 3665 - DNA, 9 bp, Artificial Sequence
  Synthetic oligonucleotide
gagtaagga

SEQ ID NO: 3666 - DNA, 9 bp, Artificial Sequence
  Synthetic oligonucleotide
gagtgaggc

SEQ ID NO: 3667 - DNA, 9 bp, Artificial Sequence
  Synthetic oligonucleotide
gagtgaggt

SEQ ID NO: 3668 - DNA, 9 bp, Artificial Sequence
  Synthetic oligonucleotide
gagtgaggt

SEQ ID NO: 3669 - DNA, 9 bp, Artificial Sequence
  Synthetic oligonucleotide
gagtgaggt

SEQ ID NO: 3670 - DNA, 9 bp, Artificial Sequence
  Synthetic oligonucleotide
gagtgaggt

SEQ ID NO: 3671 - DNA, 9 bp, Artificial Sequence
  Synthetic oligonucleotide
tagtgagga

SEQ ID NO: 3672 - DNA, 9 bp, Artificial Sequence
  Synthetic oligonucleotide
cagtgagga

SEQ ID NO: 3673 - DNA, 9 bp, Artificial Sequence
  Synthetic oligonucleotide
cagtgagga

SEQ ID NO: 3674 - DNA, 9 bp, Artificial Sequence
  Synthetic oligonucleotide
gagtgaggt

SEQ ID NO: 3675 - DNA, 9 bp, Artificial Sequence
  Synthetic oligonucleotide
gagtgaggt

SEQ ID NO: 3676 - DNA, 9 bp, Artificial Sequence
  Synthetic oligonucleotide
gagtgaggt

SEQ ID NO: 3677 - DNA, 9 bp, Artificial Sequence
  Synthetic oligonucleotide
gagtgagga

SEQ ID NO: 3678 - DNA, 9 bp, Artificial Sequence
  Synthetic oligonucleotide
gagtgagga

SEQ ID NO: 3679 - DNA, 9 bp, Artificial Sequence
  Synthetic oligonucleotide
gagtgagga

SEQ ID NO: 3680 - DNA, 9 bp, Artificial Sequence
  Synthetic oligonucleotide
gagtgagga

SEQ ID NO: 3681 - DNA, 9 bp, Artificial Sequence
  Synthetic oligonucleotide
gagtgagga

SEQ ID NO: 3682 - DNA, 9 bp, Artificial Sequence
  Synthetic oligonucleotide
gagtgagga

SEQ ID NO: 3683 - DNA, 9 bp, Artificial Sequence
  Synthetic oligonucleotide
gagtgagga

SEQ ID NO: 3684 - DNA, 9 bp, Artificial Sequence
  Synthetic oligonucleotide
gagtgagga

SEQ ID NO: 3685 - DNA, 9 bp, Artificial Sequence
  Synthetic oligonucleotide
gagtgagga

SEQ ID NO: 3686 - DNA, 9 bp, Artificial Sequence
  Synthetic oligonucleotide
gagtgagga

SEQ ID NO: 3687 - DNA, 9 bp, Artificial Sequence
  Synthetic oligonucleotide
gagtgagga

SEQ ID NO: 3688 - DNA, 9 bp, Artificial Sequence
  Synthetic oligonucleotide
gagtgagga

SEQ ID NO: 3689 - DNA, 9 bp, Artificial Sequence
  Synthetic oligonucleotide
gagtgagga

SEQ ID NO: 3690 - DNA, 9 bp, Artificial Sequence
  Synthetic oligonucleotide
gagtgagga

SEQ ID NO: 3691 - DNA, 9 bp, Artificial Sequence
  Synthetic oligonucleotide
gaggaaggt

SEQ ID NO: 3692 - DNA, 9 bp, Artificial Sequence
  Synthetic oligonucleotide
aagtgaagg

SEQ ID NO: 3693 - DNA, 9 bp, Artificial Sequence
  Synthetic oligonucleotide
gagtgagat

SEQ ID NO: 3694 - DNA, 9 bp, Artificial Sequence
  Synthetic oligonucleotide
aagtgaggt

SEQ ID NO: 3695 - DNA, 9 bp, Artificial Sequence
  Synthetic oligonucleotide
gagtgaggt

SEQ ID NO: 3696 - DNA, 9 bp, Artificial Sequence
  Synthetic oligonucleotide
gagtgaggg

SEQ ID NO: 3697 - DNA, 9 bp, Artificial Sequence
  Synthetic oligonucleotide
gagtgaggc

SEQ ID NO: 3698 - DNA, 9 bp, Artificial Sequence
  Synthetic oligonucleotide
gggtgagaa

SEQ ID NO: 3699 - DNA, 9 bp, Artificial Sequence
  Synthetic oligonucleotide
gtgtgggga

SEQ ID NO: 3700 - DNA, 9 bp, Artificial Sequence
  Synthetic oligonucleotide
gagtgagaa

SEQ ID NO: 3701 - DNA, 9 bp, Artificial Sequence
  Synthetic oligonucleotide
gagtgagca

SEQ ID NO: 3702 - DNA, 9 bp, Artificial Sequence
  Synthetic oligonucleotide
gagtgagca

SEQ ID NO: 3703 - DNA, 9 bp, Artificial Sequence
  Synthetic oligonucleotide
gagtcagga

SEQ ID NO: 3704 - DNA, 9 bp, Artificial Sequence
  Synthetic oligonucleotide
gagagagga

SEQ ID NO: 3705 - DNA, 9 bp, Artificial Sequence
  Synthetic oligonucleotide
gagtgagga

SEQ ID NO: 3706 - DNA, 9 bp, Artificial Sequence
  Synthetic oligonucleotide
gagtgagga

SEQ ID NO: 3707 - DNA, 9 bp, Artificial Sequence
  Synthetic oligonucleotide
gagtgagga

SEQ ID NO: 3708 - DNA, 9 bp, Artificial Sequence
  Synthetic oligonucleotide
gagtgagga

SEQ ID NO: 3709 - DNA, 9 bp, Artificial Sequence
  Synthetic oligonucleotide
gagtgagga

SEQ ID NO: 3710 - DNA, 9 bp, Artificial Sequence
  Synthetic oligonucleotide
gagtgagga

SEQ ID NO: 3711 - DNA, 9 bp, Artificial Sequence
  Synthetic oligonucleotide
gagtgagga

SEQ ID NO: 3712 - DNA, 9 bp, Artificial Sequence
  Synthetic oligonucleotide
gagtgagga

SEQ ID NO: 3713 - DNA, 9 bp, Artificial Sequence
  Synthetic oligonucleotide
gagtgagga

SEQ ID NO: 3714 - DNA, 9 bp, Artificial Sequence
  Synthetic oligonucleotide
gagtgagga

SEQ ID NO: 3715 - DNA, 9 bp, Artificial Sequence
  Synthetic oligonucleotide
gagtgagga

SEQ ID NO: 3716 - DNA, 9 bp, Artificial Sequence
  Synthetic oligonucleotide
gagtgagga

SEQ ID NO: 3717 - DNA, 9 bp, Artificial Sequence
  Synthetic oligonucleotide
gagtggcca

SEQ ID NO: 3718 - DNA, 9 bp, Artificial Sequence
  Synthetic oligonucleotide
gagtgggcc

SEQ ID NO: 3719 - DNA, 9 bp, Artificial Sequence
  Synthetic oligonucleotide
cagtgagac

SEQ ID NO: 3720 - DNA, 9 bp, Artificial Sequence
  Synthetic oligonucleotide
gagggaggc

SEQ ID NO: 3721 - DNA, 9 bp, Artificial Sequence
  Synthetic oligonucleotide
gagtgagac

SEQ ID NO: 3722 - DNA, 9 bp, Artificial Sequence
  Synthetic oligonucleotide
gtgtgaggc

SEQ ID NO: 3723 - DNA, 9 bp, Artificial Sequence
  Synthetic oligonucleotide
gggtgaggc

SEQ ID NO: 3724 - DNA, 9 bp, Artificial Sequence
  Synthetic oligonucleotide
gagtgagtc

SEQ ID NO: 3725 - DNA, 9 bp, Artificial Sequence
  Synthetic oligonucleotide
tagtgaggc

SEQ ID NO: 3726 - DNA, 9 bp, Artificial Sequence
  Synthetic oligonucleotide
gagggagaa

SEQ ID NO: 3727 - DNA, 9 bp, Artificial Sequence
  Synthetic oligonucleotide
gagggaggc

SEQ ID NO: 3728 - DNA, 9 bp, Artificial Sequence
  Synthetic oligonucleotide
cagtgagaa

SEQ ID NO: 3729 - DNA, 9 bp, Artificial Sequence
  Synthetic oligonucleotide
gagagaggc

SEQ ID NO: 3730 - DNA, 9 bp, Artificial Sequence
  Synthetic oligonucleotide
gagggaggg

SEQ ID NO: 3731 - DNA, 9 bp, Artificial Sequence
  Synthetic oligonucleotide
gggtgaggc

SEQ ID NO: 3732 - DNA, 9 bp, Artificial Sequence
  Synthetic oligonucleotide
gagtgagaa

SEQ ID NO: 3733 - DNA, 9 bp, Artificial Sequence
  Synthetic oligonucleotide
tagtgagga

SEQ ID NO: 3734 - DNA, 9 bp, Artificial Sequence
  Synthetic oligonucleotide
gagtgaggc

SEQ ID NO: 3735 - DNA, 9 bp, Artificial Sequence
  Synthetic oligonucleotide
gagtgaggg

SEQ ID NO: 3736 - DNA, 9 bp, Artificial Sequence
  Synthetic oligonucleotide
tagtgagga

SEQ ID NO: 3737 - DNA, 9 bp, Artificial Sequence
  Synthetic oligonucleotide
gagtgaggg

SEQ ID NO: 3738 - DNA, 9 bp, Artificial Sequence
  Synthetic oligonucleotide
gagtgagaa

SEQ ID NO: 3739 - DNA, 9 bp, Artificial Sequence
  Synthetic oligonucleotide
gagtgaggt

SEQ ID NO: 3740 - DNA, 9 bp, Artificial Sequence
  Synthetic oligonucleotide
gagtgaggc

SEQ ID NO: 3741 - DNA, 9 bp, Artificial Sequence
  Synthetic oligonucleotide
gagtgaggc

SEQ ID NO: 3742 - DNA, 9 bp, Artificial Sequence
  Synthetic oligonucleotide
gagtgaggc

SEQ ID NO: 3743 - DNA, 9 bp, Artificial Sequence
  Synthetic oligonucleotide
gagtgaggc

SEQ ID NO: 3744 - DNA, 9 bp, Artificial Sequence
  Synthetic oligonucleotide
gagtgaggt

SEQ ID NO: 3745 - DNA, 9 bp, Artificial Sequence
  Synthetic oligonucleotide
gagtgaggc

SEQ ID NO: 3746 - DNA, 9 bp, Artificial Sequence
  Synthetic oligonucleotide
tagtgagga

SEQ ID NO: 3747 - DNA, 9 bp, Artificial Sequence
  Synthetic oligonucleotide
gagtgaggt

SEQ ID NO: 3748 - DNA, 9 bp, Artificial Sequence
  Synthetic oligonucleotide
gagtgaggt

SEQ ID NO: 3749 - DNA, 9 bp, Artificial Sequence
  Synthetic oligonucleotide
gagtgaggc

SEQ ID NO: 3750 - DNA, 9 bp, Artificial Sequence
  Synthetic oligonucleotide
gagtgagaa

SEQ ID NO: 3751 - DNA, 9 bp, Artificial Sequence
  Synthetic oligonucleotide
tagtgagga

SEQ ID NO: 3752 - DNA, 9 bp, Artificial Sequence
  Synthetic oligonucleotide
gagtgaggc

SEQ ID NO: 3753 - DNA, 9 bp, Artificial Sequence
  Synthetic oligonucleotide
gagtgaggc

SEQ ID NO: 3754 - DNA, 9 bp, Artificial Sequence
  Synthetic oligonucleotide
gagtgaggc

SEQ ID NO: 3755 - DNA, 9 bp, Artificial Sequence
  Synthetic oligonucleotide
gagtgagga

SEQ ID NO: 3756 - DNA, 9 bp, Artificial Sequence
  Synthetic oligonucleotide
gagtgagga

SEQ ID NO: 3757 - DNA, 9 bp, Artificial Sequence
  Synthetic oligonucleotide
gagtgagga

SEQ ID NO: 3758 - DNA, 9 bp, Artificial Sequence
  Synthetic oligonucleotide
gagtgagga

SEQ ID NO: 3759 - DNA, 9 bp, Artificial Sequence
  Synthetic oligonucleotide
gagtgagga

SEQ ID NO: 3760 - DNA, 9 bp, Artificial Sequence
  Synthetic oligonucleotide
gagtgagga

SEQ ID NO: 3761 - DNA, 9 bp, Artificial Sequence
  Synthetic oligonucleotide
gagtgagga

SEQ ID NO: 3762 - DNA, 9 bp, Artificial Sequence
  Synthetic oligonucleotide
gagtgagga

SEQ ID NO: 3763 - DNA, 9 bp, Artificial Sequence
  Synthetic oligonucleotide
gagtgagga

SEQ ID NO: 3764 - DNA, 9 bp, Artificial Sequence
  Synthetic oligonucleotide
gagtgagga

SEQ ID NO: 3765 - DNA, 9 bp, Artificial Sequence
  Synthetic oligonucleotide
gagtgagga

SEQ ID NO: 3766 - DNA, 9 bp, Artificial Sequence
  Synthetic oligonucleotide
gagtgagga

SEQ ID NO: 3767 - DNA, 9 bp, Artificial Sequence
  Synthetic oligonucleotide
gagtgagga

SEQ ID NO: 3768 - DNA, 9 bp, Artificial Sequence
  Synthetic oligonucleotide
gagtgagga

SEQ ID NO: 3769 - DNA, 9 bp, Artificial Sequence
  Synthetic oligonucleotide
gagtgagga

SEQ ID NO: 3770 - DNA, 9 bp, Artificial Sequence
  Synthetic oligonucleotide
gagtgagga

SEQ ID NO: 3771 - DNA, 9 bp, Artificial Sequence
  Synthetic oligonucleotide
gagtgagga

SEQ ID NO: 3772 - DNA, 9 bp, Artificial Sequence
  Synthetic oligonucleotide
gagtgagga

SEQ ID NO: 3773 - DNA, 9 bp, Artificial Sequence
  Synthetic oligonucleotide
gagtgagga

SEQ ID NO: 3774 - DNA, 9 bp, Artificial Sequence
  Synthetic oligonucleotide
gagtgagga

SEQ ID NO: 3775 - DNA, 9 bp, Artificial Sequence
  Synthetic oligonucleotide
gagtgaggt

SEQ ID NO: 3776 - DNA, 9 bp, Artificial Sequence
  Synthetic oligonucleotide
gagtgaggt

SEQ ID NO: 3777 - DNA, 9 bp, Artificial Sequence
  Synthetic oligonucleotide
gagtgaggg

SEQ ID NO: 3778 - DNA, 9 bp, Artificial Sequence
  Synthetic oligonucleotide
gagtgaggc

SEQ ID NO: 3779 - DNA, 9 bp, Artificial Sequence
  Synthetic oligonucleotide
gagtgaggt

SEQ ID NO: 3780 - DNA, 9 bp, Artificial Sequence
  Synthetic oligonucleotide
aagttagga

SEQ ID NO: 3781 - DNA, 9 bp, Artificial Sequence
  Synthetic oligonucleotide
gaggcagga

SEQ ID NO: 3782 - DNA, 9 bp, Artificial Sequence
  Synthetic oligonucleotide
gggtgagga

SEQ ID NO: 3783 - DNA, 9 bp, Artificial Sequence
  Synthetic oligonucleotide
gagtgagta

SEQ ID NO: 3784 - DNA, 9 bp, Artificial Sequence
  Synthetic oligonucleotide
cagtgagga

SEQ ID NO: 3785 - DNA, 9 bp, Artificial Sequence
  Synthetic oligonucleotide
gagagagga

SEQ ID NO: 3786 - DNA, 9 bp, Artificial Sequence
  Synthetic oligonucleotide
gagtgtgga

SEQ ID NO: 3787 - DNA, 9 bp, Artificial Sequence
  Synthetic oligonucleotide
gtgtgagga

SEQ ID NO: 3788 - DNA, 9 bp, Artificial Sequence
  Synthetic oligonucleotide
gagggagga

SEQ ID NO: 3789 - DNA, 9 bp, Artificial Sequence
  Synthetic oligonucleotide
gaatgagga

SEQ ID NO: 3790 - DNA, 9 bp, Artificial Sequence
  Synthetic oligonucleotide
gagggagga

SEQ ID NO: 3791 - DNA, 9 bp, Artificial Sequence
  Synthetic oligonucleotide
cagtgagga

SEQ ID NO: 3792 - DNA, 9 bp, Artificial Sequence
  Synthetic oligonucleotide
cagtgagga

SEQ ID NO: 3793 - DNA, 9 bp, Artificial Sequence
  Synthetic oligonucleotide
gggtgagga

SEQ ID NO: 3794 - DNA, 9 bp, Artificial Sequence
  Synthetic oligonucleotide
aagtgagga

SEQ ID NO: 3795 - DNA, 9 bp, Artificial Sequence
  Synthetic oligonucleotide
aagtgagga

SEQ ID NO: 3796 - DNA, 9 bp, Artificial Sequence
  Synthetic oligonucleotide
gagttagga

SEQ ID NO: 3797 - DNA, 9 bp, Artificial Sequence
  Synthetic oligonucleotide
cagtgagga

SEQ ID NO: 3798 - DNA, 9 bp, Artificial Sequence
  Synthetic oligonucleotide
cagtgagga

SEQ ID NO: 3799 - DNA, 9 bp, Artificial Sequence
  Synthetic oligonucleotide
gtgtgagga

SEQ ID NO: 3800 - DNA, 9 bp, Artificial Sequence
  Synthetic oligonucleotide
cagtgagga

SEQ ID NO: 3801 - DNA, 9 bp, Artificial Sequence
  Synthetic oligonucleotide
aagtgagga

SEQ ID NO: 3802 - DNA, 9 bp, Artificial Sequence
  Synthetic oligonucleotide
gtgtgagga

SEQ ID NO: 3803 - DNA, 9 bp, Artificial Sequence
  Synthetic oligonucleotide
gagttagga

SEQ ID NO: 3804 - DNA, 9 bp, Artificial Sequence
  Synthetic oligonucleotide
gagcgagga

SEQ ID NO: 3805 - DNA, 9 bp, Artificial Sequence
  Synthetic oligonucleotide
aagtgagga

SEQ ID NO: 3806 - DNA, 9 bp, Artificial Sequence
  Synthetic oligonucleotide
gggtgagga

SEQ ID NO: 3807 - DNA, 9 bp, Artificial Sequence
  Synthetic oligonucleotide
gagagagga

SEQ ID NO: 3808 - DNA, 9 bp, Artificial Sequence
  Synthetic oligonucleotide
cagtgagga

SEQ ID NO: 3809 - DNA, 9 bp, Artificial Sequence
  Synthetic oligonucleotide
gagtgtgga

SEQ ID NO: 3810 - DNA, 9 bp, Artificial Sequence
  Synthetic oligonucleotide
gagtgtgga

SEQ ID NO: 3811 - DNA, 9 bp, Artificial Sequence
  Synthetic oligonucleotide
gagtgaaga

SEQ ID NO: 3812 - DNA, 9 bp, Artificial Sequence
  Synthetic oligonucleotide
gagtgaaga

SEQ ID NO: 3813 - DNA, 9 bp, Artificial Sequence
  Synthetic oligonucleotide
gagcgagga

SEQ ID NO: 3814 - DNA, 9 bp, Artificial Sequence
  Synthetic oligonucleotide
gagcgagga

SEQ ID NO: 3815 - DNA, 9 bp, Artificial Sequence
  Synthetic oligonucleotide
gagcgagga

SEQ ID NO: 3816 - DNA, 9 bp, Artificial Sequence
  Synthetic oligonucleotide
gagcgagga

SEQ ID NO: 3817 - DNA, 9 bp, Artificial Sequence
  Synthetic oligonucleotide
gagcgagga

SEQ ID NO: 3818 - DNA, 9 bp, Artificial Sequence
  Synthetic oligonucleotide
gagcgagga

SEQ ID NO: 3819 - DNA, 9 bp, Artificial Sequence
  Synthetic oligonucleotide
gagcgagga

SEQ ID NO: 3820 - DNA, 9 bp, Artificial Sequence
  Synthetic oligonucleotide
gagcgagga

SEQ ID NO: 3821 - DNA, 9 bp, Artificial Sequence
  Synthetic oligonucleotide
cagtgagga

SEQ ID NO: 3822 - DNA, 9 bp, Artificial Sequence
  Synthetic oligonucleotide
gagtgaaga

SEQ ID NO: 3823 - DNA, 9 bp, Artificial Sequence
  Synthetic oligonucleotide
aagtgagga

SEQ ID NO: 3824 - DNA, 9 bp, Artificial Sequence
  Synthetic oligonucleotide
gagtgtgga

SEQ ID NO: 3825 - DNA, 9 bp, Artificial Sequence
  Synthetic oligonucleotide
gaatgagga

SEQ ID NO: 3826 - DNA, 9 bp, Artificial Sequence
  Synthetic oligonucleotide
gagagagga

SEQ ID NO: 3827 - DNA, 9 bp, Artificial Sequence
  Synthetic oligonucleotide
gagtcagga

SEQ ID NO: 3828 - DNA, 9 bp, Artificial Sequence
  Synthetic oligonucleotide
gagtgggga

SEQ ID NO: 3829 - DNA, 9 bp, Artificial Sequence
  Synthetic oligonucleotide
gagagagga

SEQ ID NO: 3830 - DNA, 9 bp, Artificial Sequence
  Synthetic oligonucleotide
gagtgagaa

SEQ ID NO: 3831 - DNA, 9 bp, Artificial Sequence
  Synthetic oligonucleotide
gagtgggga

SEQ ID NO: 3832 - DNA, 9 bp, Artificial Sequence
  Synthetic oligonucleotide
cagtgagga

SEQ ID NO: 3833 - DNA, 9 bp, Artificial Sequence
  Synthetic oligonucleotide
aagtgagga

SEQ ID NO: 3834 - DNA, 9 bp, Artificial Sequence
  Synthetic oligonucleotide
gtgtgagga

SEQ ID NO: 3835 - DNA, 9 bp, Artificial Sequence
  Synthetic oligonucleotide
gagtgtgga

SEQ ID NO: 3836 - DNA, 9 bp, Artificial Sequence
  Synthetic oligonucleotide
gagtgagga

SEQ ID NO: 3837 - DNA, 9 bp, Artificial Sequence
  Synthetic oligonucleotide
gagtgagga

SEQ ID NO: 3838 - DNA, 9 bp, Artificial Sequence
  Synthetic oligonucleotide
gagtgagga

SEQ ID NO: 3839 - DNA, 9 bp, Artificial Sequence
  Synthetic oligonucleotide
gagtgagga

SEQ ID NO: 3840 - DNA, 9 bp, Artificial Sequence
  Synthetic oligonucleotide
gagtgagga

SEQ ID NO: 3841 - DNA, 9 bp, Artificial Sequence
  Synthetic oligonucleotide
gagtgagga

SEQ ID NO: 3842 - DNA, 9 bp, Artificial Sequence
  Synthetic oligonucleotide
gagtgagga

SEQ ID NO: 3843 - DNA, 9 bp, Artificial Sequence
  Synthetic oligonucleotide
gagtgagga

SEQ ID NO: 3844 - DNA, 9 bp, Artificial Sequence
  Synthetic oligonucleotide
gagtgagga

SEQ ID NO: 3845 - DNA, 9 bp, Artificial Sequence
  Synthetic oligonucleotide
gagtgagga

SEQ ID NO: 3846 - DNA, 9 bp, Artificial Sequence
  Synthetic oligonucleotide
gagtgagga

SEQ ID NO: 3847 - DNA, 9 bp, Artificial Sequence
  Synthetic oligonucleotide
gagtgagga

SEQ ID NO: 3848 - DNA, 9 bp, Artificial Sequence
  Synthetic oligonucleotide
gagtgagga

SEQ ID NO: 3849 - DNA, 9 bp, Artificial Sequence
  Synthetic oligonucleotide
gagtgagga

SEQ ID NO: 3850 - DNA, 9 bp, Artificial Sequence
  Synthetic oligonucleotide
gagtgagga

SEQ ID NO: 3851 - DNA, 9 bp, Artificial Sequence
  Synthetic oligonucleotide
gagtgagga

SEQ ID NO: 3852 - DNA, 9 bp, Artificial Sequence
  Synthetic oligonucleotide
gagtgagga

SEQ ID NO: 3853 - DNA, 9 bp, Artificial Sequence
  Synthetic oligonucleotide
gagtgagga

SEQ ID NO: 3854 - DNA, 9 bp, Artificial Sequence
  Synthetic oligonucleotide
gagtgagga

SEQ ID NO: 3855 - DNA, 9 bp, Artificial Sequence
  Synthetic oligonucleotide
gagtgagga

SEQ ID NO: 3856 - DNA, 9 bp, Artificial Sequence
  Synthetic oligonucleotide
gagtgagga

SEQ ID NO: 3857 - DNA, 9 bp, Artificial Sequence
  Synthetic oligonucleotide
gagtgagga

SEQ ID NO: 3858 - DNA, 9 bp, Artificial Sequence
  Synthetic oligonucleotide
gagtgagga

SEQ ID NO: 3859 - DNA, 9 bp, Artificial Sequence
  Synthetic oligonucleotide
ttgtgggga

SEQ ID NO: 3860 - DNA, 9 bp, Artificial Sequence
  Synthetic oligonucleotide
ttgtgggga

SEQ ID NO: 3861 - DNA, 9 bp, Artificial Sequence
  Synthetic oligonucleotide
gagttacaa

SEQ ID NO: 3862 - DNA, 9 bp, Artificial Sequence
  Synthetic oligonucleotide
ttgagagga

SEQ ID NO: 3863 - DNA, 9 bp, Artificial Sequence
  Synthetic oligonucleotide
cagtgtgaa

SEQ ID NO: 3864 - DNA, 9 bp, Artificial Sequence
  Synthetic oligonucleotide
cagtgtgaa

SEQ ID NO: 3865 - DNA, 9 bp, Artificial Sequence
  Synthetic oligonucleotide
gagagaagg

SEQ ID NO: 3866 - DNA, 9 bp, Artificial Sequence
  Synthetic oligonucleotide
gagttgggg

SEQ ID NO: 3867 - DNA, 9 bp, Artificial Sequence
  Synthetic oligonucleotide
gaacgtgga

SEQ ID NO: 3868 - DNA, 9 bp, Artificial Sequence
  Synthetic oligonucleotide
gagtttggg

SEQ ID NO: 3869 - DNA, 9 bp, Artificial Sequence
  Synthetic oligonucleotide
aggggagga

SEQ ID NO: 3870 - DNA, 9 bp, Artificial Sequence
  Synthetic oligonucleotide
ggctgaggg

SEQ ID NO: 3871 - DNA, 9 bp, Artificial Sequence
  Synthetic oligonucleotide
cagtggggc

SEQ ID NO: 3872 - DNA, 9 bp, Artificial Sequence
  Synthetic oligonucleotide
gagggggca

SEQ ID NO: 3873 - DNA, 9 bp, Artificial Sequence
  Synthetic oligonucleotide
gggagaggc

SEQ ID NO: 3874 - DNA, 9 bp, Artificial Sequence
  Synthetic oligonucleotide
gagtggagc

SEQ ID NO: 3875 - DNA, 9 bp, Artificial Sequence
  Synthetic oligonucleotide
cagagaggc

SEQ ID NO: 3876 - DNA, 9 bp, Artificial Sequence
  Synthetic oligonucleotide
gtgtcagaa

SEQ ID NO: 3877 - DNA, 9 bp, Artificial Sequence
  Synthetic oligonucleotide
gcatgagca

SEQ ID NO: 3878 - DNA, 9 bp, Artificial Sequence
  Synthetic oligonucleotide
aagggaaga

SEQ ID NO: 3879 - DNA, 9 bp, Artificial Sequence
  Synthetic oligonucleotide
gagttgtga

SEQ ID NO: 3880 - DNA, 9 bp, Artificial Sequence
  Synthetic oligonucleotide
gagtgctca

SEQ ID NO: 3881 - DNA, 9 bp, Artificial Sequence
  Synthetic oligonucleotide
ttgagagga

SEQ ID NO: 3882 - DNA, 9 bp, Artificial Sequence
  Synthetic oligonucleotide
gtgtaatga

SEQ ID NO: 3883 - DNA, 9 bp, Artificial Sequence
  Synthetic oligonucleotide
gagtgggtt

SEQ ID NO: 3884 - DNA, 9 bp, Artificial Sequence
  Synthetic oligonucleotide
gaggcagaa

SEQ ID NO: 3885 - DNA, 9 bp, Artificial Sequence
  Synthetic oligonucleotide
cagtgtgaa

SEQ ID NO: 3886 - DNA, 9 bp, Artificial Sequence
  Synthetic oligonucleotide
cagtgtgaa

SEQ ID NO: 3887 - DNA, 9 bp, Artificial Sequence
  Synthetic oligonucleotide
cagtgtgaa

SEQ ID NO: 3888 - DNA, 9 bp, Artificial Sequence
  Synthetic oligonucleotide
cagtgtgaa

SEQ ID NO: 3889 - DNA, 9 bp, Artificial Sequence
  Synthetic oligonucleotide
cagtgtgaa

SEQ ID NO: 3890 - DNA, 9 bp, Artificial Sequence
  Synthetic oligonucleotide
cagtgtgaa

SEQ ID NO: 3891 - DNA, 9 bp, Artificial Sequence
  Synthetic oligonucleotide
cagtgtgaa

SEQ ID NO: 3892 - DNA, 9 bp, Artificial Sequence
  Synthetic oligonucleotide
ttgagagga

SEQ ID NO: 3893 - DNA, 9 bp, Artificial Sequence
  Synthetic oligonucleotide
tactgaggt

SEQ ID NO: 3894 - DNA, 9 bp, Artificial Sequence
  Synthetic oligonucleotide
cagcgaggt

SEQ ID NO: 3895 - DNA, 9 bp, Artificial Sequence
  Synthetic oligonucleotide
gacagaggt

SEQ ID NO: 3896 - DNA, 9 bp, Artificial Sequence
  Synthetic oligonucleotide
gagagagct

SEQ ID NO: 3897 - DNA, 9 bp, Artificial Sequence
  Synthetic oligonucleotide
gaggaaggc

SEQ ID NO: 3898 - DNA, 9 bp, Artificial Sequence
  Synthetic oligonucleotide
ggctgaggt

SEQ ID NO: 3899 - DNA, 9 bp, Artificial Sequence
  Synthetic oligonucleotide
gaaggaggt

SEQ ID NO: 3900 - DNA, 9 bp, Artificial Sequence
  Synthetic oligonucleotide
gagcgatgg

SEQ ID NO: 3901 - DNA, 9 bp, Artificial Sequence
  Synthetic oligonucleotide
aagggagaa

SEQ ID NO: 3902 - DNA, 9 bp, Artificial Sequence
  Synthetic oligonucleotide
ttgagagga

SEQ ID NO: 3903 - DNA, 9 bp, Artificial Sequence
  Synthetic oligonucleotide
gtgtgcggt

SEQ ID NO: 3904 - DNA, 9 bp, Artificial Sequence
  Synthetic oligonucleotide
tagagggga

SEQ ID NO: 3905 - DNA, 9 bp, Artificial Sequence
  Synthetic oligonucleotide
gaggtaggg

SEQ ID NO: 3906 - DNA, 9 bp, Artificial Sequence
  Synthetic oligonucleotide
gtgttacga

SEQ ID NO: 3907 - DNA, 9 bp, Artificial Sequence
  Synthetic oligonucleotide
ctgtgaggg

SEQ ID NO: 3908 - DNA, 9 bp, Artificial Sequence
  Synthetic oligonucleotide
gagggagag

SEQ ID NO: 3909 - DNA, 9 bp, Artificial Sequence
  Synthetic oligonucleotide
gaggggaga

SEQ ID NO: 3910 - DNA, 9 bp, Artificial Sequence
  Synthetic oligonucleotide
cagtgatgg

SEQ ID NO: 3911 - DNA, 9 bp, Artificial Sequence
  Synthetic oligonucleotide
gagagaagg

SEQ ID NO: 3912 - DNA, 9 bp, Artificial Sequence
  Synthetic oligonucleotide
gagtccaga

SEQ ID NO: 3913 - DNA, 9 bp, Artificial Sequence
  Synthetic oligonucleotide
tagagagta

SEQ ID NO: 3914 - DNA, 9 bp, Artificial Sequence
  Synthetic oligonucleotide
gagagaagg

SEQ ID NO: 3915 - DNA, 9 bp, Artificial Sequence
  Synthetic oligonucleotide
gagtgtgaa

SEQ ID NO: 3916 - DNA, 9 bp, Artificial Sequence
  Synthetic oligonucleotide
gagtgagac

SEQ ID NO: 3917 - DNA, 9 bp, Artificial Sequence
  Synthetic oligonucleotide
gagggaggg

SEQ ID NO: 3918 - DNA, 9 bp, Artificial Sequence
  Synthetic oligonucleotide
cagtgaggt

SEQ ID NO: 3919 - DNA, 9 bp, Artificial Sequence
  Synthetic oligonucleotide
gagggaggc

SEQ ID NO: 3920 - DNA, 9 bp, Artificial Sequence
  Synthetic oligonucleotide
gagtgatgt

SEQ ID NO: 3921 - DNA, 9 bp, Artificial Sequence
  Synthetic oligonucleotide
gagtgagtg

SEQ ID NO: 3922 - DNA, 9 bp, Artificial Sequence
  Synthetic oligonucleotide
gagagaggc

SEQ ID NO: 3923 - DNA, 9 bp, Artificial Sequence
  Synthetic oligonucleotide
gagtaaggt

SEQ ID NO: 3924 - DNA, 9 bp, Artificial Sequence
  Synthetic oligonucleotide
tagtgagaa

SEQ ID NO: 3925 - DNA, 9 bp, Artificial Sequence
  Synthetic oligonucleotide
gagggaaga

SEQ ID NO: 3926 - DNA, 9 bp, Artificial Sequence
  Synthetic oligonucleotide
gagggaggc

SEQ ID NO: 3927 - DNA, 9 bp, Artificial Sequence
  Synthetic oligonucleotide
gagtgagag

SEQ ID NO: 3928 - DNA, 9 bp, Artificial Sequence
  Synthetic oligonucleotide
aagtgaggg

SEQ ID NO: 3929 - DNA, 9 bp, Artificial Sequence
  Synthetic oligonucleotide
cagtgggga

SEQ ID NO: 3930 - DNA, 9 bp, Artificial Sequence
  Synthetic oligonucleotide
gtctgagga

SEQ ID NO: 3931 - DNA, 9 bp, Artificial Sequence
  Synthetic oligonucleotide
tagtgagaa

SEQ ID NO: 3932 - DNA, 9 bp, Artificial Sequence
  Synthetic oligonucleotide
gagtggggt

SEQ ID NO: 3933 - DNA, 9 bp, Artificial Sequence
  Synthetic oligonucleotide
cagtgaggt

SEQ ID NO: 3934 - DNA, 9 bp, Artificial Sequence
  Synthetic oligonucleotide
tagtgaggg

SEQ ID NO: 3935 - DNA, 9 bp, Artificial Sequence
  Synthetic oligonucleotide
gagtgagcc

SEQ ID NO: 3936 - DNA, 9 bp, Artificial Sequence
  Synthetic oligonucleotide
aagtgagaa

SEQ ID NO: 3937 - DNA, 9 bp, Artificial Sequence
  Synthetic oligonucleotide
gagagagaa

SEQ ID NO: 3938 - DNA, 9 bp, Artificial Sequence
  Synthetic oligonucleotide
cagtaagga

SEQ ID NO: 3939 - DNA, 9 bp, Artificial Sequence
  Synthetic oligonucleotide
gagtgagtg

SEQ ID NO: 3940 - DNA, 9 bp, Artificial Sequence
  Synthetic oligonucleotide
gagggaggg

SEQ ID NO: 3941 - DNA, 9 bp, Artificial Sequence
  Synthetic oligonucleotide
gggtgaggc

SEQ ID NO: 3942 - DNA, 9 bp, Artificial Sequence
  Synthetic oligonucleotide
gagcgaggg

SEQ ID NO: 3943 - DNA, 9 bp, Artificial Sequence
  Synthetic oligonucleotide
cagtgaggt

SEQ ID NO: 3944 - DNA, 9 bp, Artificial Sequence
  Synthetic oligonucleotide
gtgtgaggt

SEQ ID NO: 3945 - DNA, 9 bp, Artificial Sequence
  Synthetic oligonucleotide
cagtgaggc

SEQ ID NO: 3946 - DNA, 9 bp, Artificial Sequence
  Synthetic oligonucleotide
gagggagaa

SEQ ID NO: 3947 - DNA, 9 bp, Artificial Sequence
  Synthetic oligonucleotide
gagggaggg

SEQ ID NO: 3948 - DNA, 9 bp, Artificial Sequence
  Synthetic oligonucleotide
gagtgagcc

SEQ ID NO: 3949 - DNA, 9 bp, Artificial Sequence
  Synthetic oligonucleotide
gagggaggg

SEQ ID NO: 3950 - DNA, 9 bp, Artificial Sequence
  Synthetic oligonucleotide
gagggaggg

SEQ ID NO: 3951 - DNA, 9 bp, Artificial Sequence
  Synthetic oligonucleotide
gagggaggg

SEQ ID NO: 3952 - DNA, 9 bp, Artificial Sequence
  Synthetic oligonucleotide
gagggaggg

SEQ ID NO: 3953 - DNA, 9 bp, Artificial Sequence
  Synthetic oligonucleotide
gagggaggg

SEQ ID NO: 3954 - DNA, 9 bp, Artificial Sequence
  Synthetic oligonucleotide
gagggaggg

SEQ ID NO: 3955 - DNA, 9 bp, Artificial Sequence
  Synthetic oligonucleotide
gagggaggg

SEQ ID NO: 3956 - DNA, 9 bp, Artificial Sequence
  Synthetic oligonucleotide
gagggaggg

SEQ ID NO: 3957 - DNA, 9 bp, Artificial Sequence
  Synthetic oligonucleotide
cagtgaggg

SEQ ID NO: 3958 - DNA, 9 bp, Artificial Sequence
  Synthetic oligonucleotide
gtgtgagaa

SEQ ID NO: 3959 - DNA, 9 bp, Artificial Sequence
  Synthetic oligonucleotide
tagtgaggg

SEQ ID NO: 3960 - DNA, 9 bp, Artificial Sequence
  Synthetic oligonucleotide
gagggaggt

SEQ ID NO: 3961 - DNA, 9 bp, Artificial Sequence
  Synthetic oligonucleotide
cagtgaggg

SEQ ID NO: 3962 - DNA, 9 bp, Artificial Sequence
  Synthetic oligonucleotide
gagggaggc

SEQ ID NO: 3963 - DNA, 9 bp, Artificial Sequence
  Synthetic oligonucleotide
gagtggggc

SEQ ID NO: 3964 - DNA, 9 bp, Artificial Sequence
  Synthetic oligonucleotide
gagtgacaa

SEQ ID NO: 3965 - DNA, 9 bp, Artificial Sequence
  Synthetic oligonucleotide
gagtgatgt

SEQ ID NO: 3966 - DNA, 9 bp, Artificial Sequence
  Synthetic oligonucleotide
gagtgagtt

SEQ ID NO: 3967 - DNA, 9 bp, Artificial Sequence
  Synthetic oligonucleotide
gagggaggc

SEQ ID NO: 3968 - DNA, 9 bp, Artificial Sequence
  Synthetic oligonucleotide
gagagaggc

SEQ ID NO: 3969 - DNA, 9 bp, Artificial Sequence
  Synthetic oligonucleotide
cagtgaggg

SEQ ID NO: 3970 - DNA, 9 bp, Artificial Sequence
  Synthetic oligonucleotide
gagtgagtt

SEQ ID NO: 3971 - DNA, 9 bp, Artificial Sequence
  Synthetic oligonucleotide
gagtgagtt

SEQ ID NO: 3972 - DNA, 9 bp, Artificial Sequence
  Synthetic oligonucleotide
gagggaggt

SEQ ID NO: 3973 - DNA, 9 bp, Artificial Sequence
  Synthetic oligonucleotide
gggtgaggg

SEQ ID NO: 3974 - DNA, 9 bp, Artificial Sequence
  Synthetic oligonucleotide
cagtgaggc

SEQ ID NO: 3975 - DNA, 9 bp, Artificial Sequence
  Synthetic oligonucleotide
gagagaggt

SEQ ID NO: 3976 - DNA, 9 bp, Artificial Sequence
  Synthetic oligonucleotide
gagtgagcc

SEQ ID NO: 3977 - DNA, 9 bp, Artificial Sequence
  Synthetic oligonucleotide
gagtgaagg

SEQ ID NO: 3978 - DNA, 9 bp, Artificial Sequence
  Synthetic oligonucleotide
tagtgaggg

SEQ ID NO: 3979 - DNA, 9 bp, Artificial Sequence
  Synthetic oligonucleotide
tagtgaggg

SEQ ID NO: 3980 - DNA, 9 bp, Artificial Sequence
  Synthetic oligonucleotide
gaggaagga

SEQ ID NO: 3981 - DNA, 9 bp, Artificial Sequence
  Synthetic oligonucleotide
gagagaggt

SEQ ID NO: 3982 - DNA, 9 bp, Artificial Sequence
  Synthetic oligonucleotide
gggtgaggg

SEQ ID NO: 3983 - DNA, 9 bp, Artificial Sequence
  Synthetic oligonucleotide
gagtgaagg

SEQ ID NO: 3984 - DNA, 9 bp, Artificial Sequence
  Synthetic oligonucleotide
tggtgagga

SEQ ID NO: 3985 - DNA, 9 bp, Artificial Sequence
  Synthetic oligonucleotide
gagagaggg

SEQ ID NO: 3986 - DNA, 9 bp, Artificial Sequence
  Synthetic oligonucleotide
gagagaggc

SEQ ID NO: 3987 - DNA, 9 bp, Artificial Sequence
  Synthetic oligonucleotide
gactgaggc

SEQ ID NO: 3988 - DNA, 9 bp, Artificial Sequence
  Synthetic oligonucleotide
gtgtgaggc

SEQ ID NO: 3989 - DNA, 9 bp, Artificial Sequence
  Synthetic oligonucleotide
gactgaggc

SEQ ID NO: 3990 - DNA, 9 bp, Artificial Sequence
  Synthetic oligonucleotide
gagagaggg

SEQ ID NO: 3991 - DNA, 9 bp, Artificial Sequence
  Synthetic oligonucleotide
gactgaggc

SEQ ID NO: 3992 - DNA, 9 bp, Artificial Sequence
  Synthetic oligonucleotide
gactgaggc

SEQ ID NO: 3993 - DNA, 9 bp, Artificial Sequence
  Synthetic oligonucleotide
gactgaggc

SEQ ID NO: 3994 - DNA, 9 bp, Artificial Sequence
  Synthetic oligonucleotide
gactgaggc

SEQ ID NO: 3995 - DNA, 9 bp, Artificial Sequence
  Synthetic oligonucleotide
gactgaggc

SEQ ID NO: 3996 - DNA, 9 bp, Artificial Sequence
  Synthetic oligonucleotide
gagagaggg

SEQ ID NO: 3997 - DNA, 9 bp, Artificial Sequence
  Synthetic oligonucleotide
gactgaggc

SEQ ID NO: 3998 - DNA, 9 bp, Artificial Sequence
  Synthetic oligonucleotide
tagtgaggc

SEQ ID NO: 3999 - DNA, 9 bp, Artificial Sequence
  Synthetic oligonucleotide
gtgtgagaa

SEQ ID NO: 4000 - DNA, 9 bp, Artificial Sequence
  Synthetic oligonucleotide
gaatgaggg

SEQ ID NO: 4001 - DNA, 9 bp, Artificial Sequence
  Synthetic oligonucleotide
gggtgaggt

SEQ ID NO: 4002 - DNA, 9 bp, Artificial Sequence
  Synthetic oligonucleotide
gaatgaggg

SEQ ID NO: 4003 - DNA, 9 bp, Artificial Sequence
  Synthetic oligonucleotide
gagtgtggt

SEQ ID NO: 4004 - DNA, 9 bp, Artificial Sequence
  Synthetic oligonucleotide
gagtgagcc

SEQ ID NO: 4005 - DNA, 9 bp, Artificial Sequence
  Synthetic oligonucleotide
gagtgggaa

SEQ ID NO: 4006 - DNA, 9 bp, Artificial Sequence
  Synthetic oligonucleotide
cagtgaggg

SEQ ID NO: 4007 - DNA, 9 bp, Artificial Sequence
  Synthetic oligonucleotide
gactgaggg

SEQ ID NO: 4008 - DNA, 9 bp, Artificial Sequence
  Synthetic oligonucleotide
gagtgagct

SEQ ID NO: 4009 - DNA, 9 bp, Artificial Sequence
  Synthetic oligonucleotide
gggagagga

SEQ ID NO: 4010 - DNA, 9 bp, Artificial Sequence
  Synthetic oligonucleotide
gagtgatgt

SEQ ID NO: 4011 - DNA, 9 bp, Artificial Sequence
  Synthetic oligonucleotide
gagtgggaa

SEQ ID NO: 4012 - DNA, 9 bp, Artificial Sequence
  Synthetic oligonucleotide
cagtgaggt

SEQ ID NO: 4013 - DNA, 9 bp, Artificial Sequence
  Synthetic oligonucleotide
gagagagca

SEQ ID NO: 4014 - DNA, 9 bp, Artificial Sequence
  Synthetic oligonucleotide
tagtgaggt

SEQ ID NO: 4015 - DNA, 9 bp, Artificial Sequence
  Synthetic oligonucleotide
gagagaggg

SEQ ID NO: 4016 - DNA, 9 bp, Artificial Sequence
  Synthetic oligonucleotide
cagtgagta

SEQ ID NO: 4017 - DNA, 9 bp, Artificial Sequence
  Synthetic oligonucleotide
gagggtgga

SEQ ID NO: 4018 - DNA, 9 bp, Artificial Sequence
  Synthetic oligonucleotide
gagggaggt

SEQ ID NO: 4019 - DNA, 9 bp, Artificial Sequence
  Synthetic oligonucleotide
gagtaaggc

SEQ ID NO: 4020 - DNA, 9 bp, Artificial Sequence
  Synthetic oligonucleotide
gagtggggg

SEQ ID NO: 4021 - DNA, 9 bp, Artificial Sequence
  Synthetic oligonucleotide
gagggaggg

SEQ ID NO: 4022 - DNA, 9 bp, Artificial Sequence
  Synthetic oligonucleotide
gagggaggg

SEQ ID NO: 4023 - DNA, 9 bp, Artificial Sequence
  Synthetic oligonucleotide
gagggaggg

SEQ ID NO: 4024 - DNA, 9 bp, Artificial Sequence
  Synthetic oligonucleotide
gagggaggg

SEQ ID NO: 4025 - DNA, 9 bp, Artificial Sequence
  Synthetic oligonucleotide
gagggaggg

SEQ ID NO: 4026 - DNA, 9 bp, Artificial Sequence
  Synthetic oligonucleotide
gagggaggg

SEQ ID NO: 4027 - DNA, 9 bp, Artificial Sequence
  Synthetic oligonucleotide
gagggaggg

SEQ ID NO: 4028 - DNA, 9 bp, Artificial Sequence
  Synthetic oligonucleotide
gagggaggg

SEQ ID NO: 4029 - DNA, 9 bp, Artificial Sequence
  Synthetic oligonucleotide
gagggaggg

SEQ ID NO: 4030 - DNA, 9 bp, Artificial Sequence
  Synthetic oligonucleotide
gagggaggg

SEQ ID NO: 4031 - DNA, 9 bp, Artificial Sequence
  Synthetic oligonucleotide
gagggaggg

SEQ ID NO: 4032 - DNA, 9 bp, Artificial Sequence
  Synthetic oligonucleotide
cagtgaggg

SEQ ID NO: 4033 - DNA, 9 bp, Artificial Sequence
  Synthetic oligonucleotide
gagggaggg

SEQ ID NO: 4034 - DNA, 9 bp, Artificial Sequence
  Synthetic oligonucleotide
gtgtgaggg

SEQ ID NO: 4035 - DNA, 9 bp, Artificial Sequence
  Synthetic oligonucleotide
gagggaggg

SEQ ID NO: 4036 - DNA, 9 bp, Artificial Sequence
  Synthetic oligonucleotide
gagggaggc

SEQ ID NO: 4037 - DNA, 9 bp, Artificial Sequence
  Synthetic oligonucleotide
gagtggggg

SEQ ID NO: 4038 - DNA, 9 bp, Artificial Sequence
  Synthetic oligonucleotide
gagagaggg

SEQ ID NO: 4039 - DNA, 9 bp, Artificial Sequence
  Synthetic oligonucleotide
gtgggagga

SEQ ID NO: 4040 - DNA, 9 bp, Artificial Sequence
  Synthetic oligonucleotide
gggtgaggg

SEQ ID NO: 4041 - DNA, 9 bp, Artificial Sequence
  Synthetic oligonucleotide
cagtgaggt

SEQ ID NO: 4042 - DNA, 9 bp, Artificial Sequence
  Synthetic oligonucleotide
gagtgtggt

SEQ ID NO: 4043 - DNA, 9 bp, Artificial Sequence
  Synthetic oligonucleotide
cagtgaggg

SEQ ID NO: 4044 - DNA, 9 bp, Artificial Sequence
  Synthetic oligonucleotide
gagtggggt

SEQ ID NO: 4045 - DNA, 9 bp, Artificial Sequence
  Synthetic oligonucleotide
gagcgggga

SEQ ID NO: 4046 - DNA, 9 bp, Artificial Sequence
  Synthetic oligonucleotide
aagtgaggg

SEQ ID NO: 4047 - DNA, 9 bp, Artificial Sequence
  Synthetic oligonucleotide
gagagaggg

SEQ ID NO: 4048 - DNA, 9 bp, Artificial Sequence
  Synthetic oligonucleotide
gagtaaggg

SEQ ID NO: 4049 - DNA, 9 bp, Artificial Sequence
  Synthetic oligonucleotide
gagttaggt

SEQ ID NO: 4050 - DNA, 9 bp, Artificial Sequence
  Synthetic oligonucleotide
gtgtgaggc

SEQ ID NO: 4051 - DNA, 9 bp, Artificial Sequence
  Synthetic oligonucleotide
aagtgaggc

SEQ ID NO: 4052 - DNA, 9 bp, Artificial Sequence
  Synthetic oligonucleotide
aagtgagga

SEQ ID NO: 4053 - DNA, 9 bp, Artificial Sequence
  Synthetic oligonucleotide
aagtgagga

SEQ ID NO: 4054 - DNA, 9 bp, Artificial Sequence
  Synthetic oligonucleotide
aagtgagga

SEQ ID NO: 4055 - DNA, 9 bp, Artificial Sequence
  Synthetic oligonucleotide
aagtgagga

SEQ ID NO: 4056 - DNA, 9 bp, Artificial Sequence
  Synthetic oligonucleotide
cagtgagga

SEQ ID NO: 4057 - DNA, 9 bp, Artificial Sequence
  Synthetic oligonucleotide
gagtgaggg

SEQ ID NO: 4058 - DNA, 9 bp, Artificial Sequence
  Synthetic oligonucleotide
cagtgagga

SEQ ID NO: 4059 - DNA, 9 bp, Artificial Sequence
  Synthetic oligonucleotide
gagtgaggt

SEQ ID NO: 4060 - DNA, 9 bp, Artificial Sequence
  Synthetic oligonucleotide
gagtgaggg

SEQ ID NO: 4061 - DNA, 9 bp, Artificial Sequence
  Synthetic oligonucleotide
gagtgaggt

SEQ ID NO: 4062 - DNA, 9 bp, Artificial Sequence
  Synthetic oligonucleotide
gagtgaggc

SEQ ID NO: 4063 - DNA, 9 bp, Artificial Sequence
  Synthetic oligonucleotide
cagtgagga

SEQ ID NO: 4064 - DNA, 9 bp, Artificial Sequence
  Synthetic oligonucleotide
gagtgaggt

SEQ ID NO: 4065 - DNA, 9 bp, Artificial Sequence
  Synthetic oligonucleotide
gagggagga

SEQ ID NO: 4066 - DNA, 9 bp, Artificial Sequence
  Synthetic oligonucleotide
tagtgagga

SEQ ID NO: 4067 - DNA, 9 bp, Artificial Sequence
  Synthetic oligonucleotide
gagtgaggg

SEQ ID NO: 4068 - DNA, 9 bp, Artificial Sequence
  Synthetic oligonucleotide
gagagagga

SEQ ID NO: 4069 - DNA, 9 bp, Artificial Sequence
  Synthetic oligonucleotide
gagtgaggt

SEQ ID NO: 4070 - DNA, 9 bp, Artificial Sequence
  Synthetic oligonucleotide
gagggagga

SEQ ID NO: 4071 - DNA, 9 bp, Artificial Sequence
  Synthetic oligonucleotide
gagtgaggg

SEQ ID NO: 4072 - DNA, 9 bp, Artificial Sequence
  Synthetic oligonucleotide
gagggagga

SEQ ID NO: 4073 - DNA, 9 bp, Artificial Sequence
  Synthetic oligonucleotide
aagtgagga

SEQ ID NO: 4074 - DNA, 9 bp, Artificial Sequence
  Synthetic oligonucleotide
gagcgagga

SEQ ID NO: 4075 - DNA, 9 bp, Artificial Sequence
  Synthetic oligonucleotide
cagtgagga

SEQ ID NO: 4076 - DNA, 9 bp, Artificial Sequence
  Synthetic oligonucleotide
gagtgaggg

SEQ ID NO: 4077 - DNA, 9 bp, Artificial Sequence
  Synthetic oligonucleotide
aagtgagga

SEQ ID NO: 4078 - DNA, 9 bp, Artificial Sequence
  Synthetic oligonucleotide
gagtgaggt

SEQ ID NO: 4079 - DNA, 9 bp, Artificial Sequence
  Synthetic oligonucleotide
gggtgagga

SEQ ID NO: 4080 - DNA, 9 bp, Artificial Sequence
  Synthetic oligonucleotide
gagtgaggt

SEQ ID NO: 4081 - DNA, 9 bp, Artificial Sequence
  Synthetic oligonucleotide
tagtgagga

SEQ ID NO: 4082 - DNA, 9 bp, Artificial Sequence
  Synthetic oligonucleotide
aagtgagga

SEQ ID NO: 4083 - DNA, 9 bp, Artificial Sequence
  Synthetic oligonucleotide
cagtgagga

SEQ ID NO: 4084 - DNA, 9 bp, Artificial Sequence
  Synthetic oligonucleotide
gagtgaggg

SEQ ID NO: 4085 - DNA, 9 bp, Artificial Sequence
  Synthetic oligonucleotide
gagagagga

SEQ ID NO: 4086 - DNA, 9 bp, Artificial Sequence
  Synthetic oligonucleotide
gagtgagca

SEQ ID NO: 4087 - DNA, 9 bp, Artificial Sequence
  Synthetic oligonucleotide
gagtaagga

SEQ ID NO: 4088 - DNA, 9 bp, Artificial Sequence
  Synthetic oligonucleotide
gagtgaggc

SEQ ID NO: 4089 - DNA, 9 bp, Artificial Sequence
  Synthetic oligonucleotide
gagtgaaga

SEQ ID NO: 4090 - DNA, 9 bp, Artificial Sequence
  Synthetic oligonucleotide
gagtgaggg

SEQ ID NO: 4091 - DNA, 9 bp, Artificial Sequence
  Synthetic oligonucleotide
gagtaagga

SEQ ID NO: 4092 - DNA, 9 bp, Artificial Sequence
  Synthetic oligonucleotide
gagtgaggg

SEQ ID NO: 4093 - DNA, 9 bp, Artificial Sequence
  Synthetic oligonucleotide
gagtgaggt

SEQ ID NO: 4094 - DNA, 9 bp, Artificial Sequence
  Synthetic oligonucleotide
gagggagga

SEQ ID NO: 4095 - DNA, 9 bp, Artificial Sequence
  Synthetic oligonucleotide
cagtgagga

SEQ ID NO: 4096 - DNA, 9 bp, Artificial Sequence
  Synthetic oligonucleotide
gagtgaggg

SEQ ID NO: 4097 - DNA, 9 bp, Artificial Sequence
  Synthetic oligonucleotide
gagtgtgga

SEQ ID NO: 4098 - DNA, 9 bp, Artificial Sequence
  Synthetic oligonucleotide
gagtgaggg

SEQ ID NO: 4099 - DNA, 9 bp, Artificial Sequence
  Synthetic oligonucleotide
gagggagga

SEQ ID NO: 4100 - DNA, 9 bp, Artificial Sequence
  Synthetic oligonucleotide
gagtaagga

SEQ ID NO: 4101 - DNA, 9 bp, Artificial Sequence
  Synthetic oligonucleotide
aagtgagga

SEQ ID NO: 4102 - DNA, 9 bp, Artificial Sequence
  Synthetic oligonucleotide
gagtgaggg

SEQ ID NO: 4103 - DNA, 9 bp, Artificial Sequence
  Synthetic oligonucleotide
gagtgaggc

SEQ ID NO: 4104 - DNA, 9 bp, Artificial Sequence
  Synthetic oligonucleotide
gagtgagaa

SEQ ID NO: 4105 - DNA, 9 bp, Artificial Sequence
  Synthetic oligonucleotide
gagtgagta

SEQ ID NO: 4106 - DNA, 9 bp, Artificial Sequence
  Synthetic oligonucleotide
gagtgaggg

SEQ ID NO: 4107 - DNA, 9 bp, Artificial Sequence
  Synthetic oligonucleotide
gtgtgagga

SEQ ID NO: 4108 - DNA, 9 bp, Artificial Sequence
  Synthetic oligonucleotide
gagtgaggg

SEQ ID NO: 4109 - DNA, 9 bp, Artificial Sequence
  Synthetic oligonucleotide
aagtgagga

SEQ ID NO: 4110 - DNA, 9 bp, Artificial Sequence
  Synthetic oligonucleotide
gagtgggga

SEQ ID NO: 4111 - DNA, 9 bp, Artificial Sequence
  Synthetic oligonucleotide
gagtgaggg

SEQ ID NO: 4112 - DNA, 9 bp, Artificial Sequence
  Synthetic oligonucleotide
gagtgaggt

SEQ ID NO: 4113 - DNA, 9 bp, Artificial Sequence
  Synthetic oligonucleotide
gagtgaggg

SEQ ID NO: 4114 - DNA, 9 bp, Artificial Sequence
  Synthetic oligonucleotide
aagtgagga

SEQ ID NO: 4115 - DNA, 9 bp, Artificial Sequence
  Synthetic oligonucleotide
gagtgaggg

SEQ ID NO: 4116 - DNA, 9 bp, Artificial Sequence
  Synthetic oligonucleotide
aagtgagga

SEQ ID NO: 4117 - DNA, 9 bp, Artificial Sequence
  Synthetic oligonucleotide
gagtgagca

SEQ ID NO: 4118 - DNA, 9 bp, Artificial Sequence
  Synthetic oligonucleotide
cagtgagga

SEQ ID NO: 4119 - DNA, 9 bp, Artificial Sequence
  Synthetic oligonucleotide
gagtgaggc

SEQ ID NO: 4120 - DNA, 9 bp, Artificial Sequence
  Synthetic oligonucleotide
aagtgagga

SEQ ID NO: 4121 - DNA, 9 bp, Artificial Sequence
  Synthetic oligonucleotide
gagggagga

SEQ ID NO: 4122 - DNA, 9 bp, Artificial Sequence
  Synthetic oligonucleotide
gagtgaggc

SEQ ID NO: 4123 - DNA, 9 bp, Artificial Sequence
  Synthetic oligonucleotide
cagtgagga

SEQ ID NO: 4124 - DNA, 9 bp, Artificial Sequence
  Synthetic oligonucleotide
tagtgagga

SEQ ID NO: 4125 - DNA, 9 bp, Artificial Sequence
  Synthetic oligonucleotide
gagtgaggg

SEQ ID NO: 4126 - DNA, 9 bp, Artificial Sequence
  Synthetic oligonucleotide
gagtgaggt

SEQ ID NO: 4127 - DNA, 9 bp, Artificial Sequence
  Synthetic oligonucleotide
gagtgagaa

SEQ ID NO: 4128 - DNA, 9 bp, Artificial Sequence
  Synthetic oligonucleotide
gagtgaggg

SEQ ID NO: 4129 - DNA, 9 bp, Artificial Sequence
  Synthetic oligonucleotide
gagagagga

SEQ ID NO: 4130 - DNA, 9 bp, Artificial Sequence
  Synthetic oligonucleotide
aagtgagga

SEQ ID NO: 4131 - DNA, 9 bp, Artificial Sequence
  Synthetic oligonucleotide
gagtgaggg

SEQ ID NO: 4132 - DNA, 9 bp, Artificial Sequence
  Synthetic oligonucleotide
aagtgagga

SEQ ID NO: 4133 - DNA, 9 bp, Artificial Sequence
  Synthetic oligonucleotide
aagtgagga

SEQ ID NO: 4134 - DNA, 9 bp, Artificial Sequence
  Synthetic oligonucleotide
gagtgaggt

SEQ ID NO: 4135 - DNA, 9 bp, Artificial Sequence
  Synthetic oligonucleotide
gagtgaggt

SEQ ID NO: 4136 - DNA, 9 bp, Artificial Sequence
  Synthetic oligonucleotide
cagtgagga

SEQ ID NO: 4137 - DNA, 9 bp, Artificial Sequence
  Synthetic oligonucleotide
gagtgaggc

SEQ ID NO: 4138 - DNA, 9 bp, Artificial Sequence
  Synthetic oligonucleotide
gtgtgagga

SEQ ID NO: 4139 - DNA, 9 bp, Artificial Sequence
  Synthetic oligonucleotide
gagtgaggg

SEQ ID NO: 4140 - DNA, 9 bp, Artificial Sequence
  Synthetic oligonucleotide
aagtgagga

SEQ ID NO: 4141 - DNA, 9 bp, Artificial Sequence
  Synthetic oligonucleotide
gaatgagga

SEQ ID NO: 4142 - DNA, 9 bp, Artificial Sequence
  Synthetic oligonucleotide
gagcgagga

SEQ ID NO: 4143 - DNA, 9 bp, Artificial Sequence
  Synthetic oligonucleotide
gagagagga

SEQ ID NO: 4144 - DNA, 9 bp, Artificial Sequence
  Synthetic oligonucleotide
gagtgaggc

SEQ ID NO: 4145 - DNA, 9 bp, Artificial Sequence
  Synthetic oligonucleotide
gagtgaggt

SEQ ID NO: 4146 - DNA, 9 bp, Artificial Sequence
  Synthetic oligonucleotide
gagtgaggc

SEQ ID NO: 4147 - DNA, 9 bp, Artificial Sequence
  Synthetic oligonucleotide
aagtgagga

SEQ ID NO: 4148 - DNA, 9 bp, Artificial Sequence
  Synthetic oligonucleotide
aagtgagga

SEQ ID NO: 4149 - DNA, 9 bp, Artificial Sequence
  Synthetic oligonucleotide
aagtgagga

SEQ ID NO: 4150 - DNA, 9 bp, Artificial Sequence
  Synthetic oligonucleotide
gagtgaggc

SEQ ID NO: 4151 - DNA, 9 bp, Artificial Sequence
  Synthetic oligonucleotide
gagtgaggg

SEQ ID NO: 4152 - DNA, 9 bp, Artificial Sequence
  Synthetic oligonucleotide
gagtgaggc

SEQ ID NO: 4153 - DNA, 9 bp, Artificial Sequence
  Synthetic oligonucleotide
gagtgagaa

SEQ ID NO: 4154 - DNA, 9 bp, Artificial Sequence
  Synthetic oligonucleotide
gagtgaggt

SEQ ID NO: 4155 - DNA, 9 bp, Artificial Sequence
  Synthetic oligonucleotide
gagtgaggg

SEQ ID NO: 4156 - DNA, 9 bp, Artificial Sequence
  Synthetic oligonucleotide
gagtgaggc

SEQ ID NO: 4157 - DNA, 9 bp, Artificial Sequence
  Synthetic oligonucleotide
gagtgtgga

SEQ ID NO: 4158 - DNA, 9 bp, Artificial Sequence
  Synthetic oligonucleotide
gagtgaggg

SEQ ID NO: 4159 - DNA, 9 bp, Artificial Sequence
  Synthetic oligonucleotide
gagtgaggt

SEQ ID NO: 4160 - DNA, 9 bp, Artificial Sequence
  Synthetic oligonucleotide
aagtgagga

SEQ ID NO: 4161 - DNA, 9 bp, Artificial Sequence
  Synthetic oligonucleotide
gagtgaggc

SEQ ID NO: 4162 - DNA, 9 bp, Artificial Sequence
  Synthetic oligonucleotide
gagtgaggt

SEQ ID NO: 4163 - DNA, 9 bp, Artificial Sequence
  Synthetic oligonucleotide
gagtgaggg

SEQ ID NO: 4164 - DNA, 9 bp, Artificial Sequence
  Synthetic oligonucleotide
gagtgaggg

SEQ ID NO: 4165 - DNA, 9 bp, Artificial Sequence
  Synthetic oligonucleotide
gagtgagca

SEQ ID NO: 4166 - DNA, 9 bp, Artificial Sequence
  Synthetic oligonucleotide
gagtgaggt

SEQ ID NO: 4167 - DNA, 9 bp, Artificial Sequence
  Synthetic oligonucleotide
gagtgaaga

SEQ ID NO: 4168 - DNA, 9 bp, Artificial Sequence
  Synthetic oligonucleotide
gagtgaggc

SEQ ID NO: 4169 - DNA, 9 bp, Artificial Sequence
  Synthetic oligonucleotide
cagtgagga

SEQ ID NO: 4170 - DNA, 9 bp, Artificial Sequence
  Synthetic oligonucleotide
gagtgaggc

SEQ ID NO: 4171 - DNA, 9 bp, Artificial Sequence
  Synthetic oligonucleotide
gagggagga

SEQ ID NO: 4172 - DNA, 9 bp, Artificial Sequence
  Synthetic oligonucleotide
gagtgagaa

SEQ ID NO: 4173 - DNA, 9 bp, Artificial Sequence
  Synthetic oligonucleotide
gagggagga

SEQ ID NO: 4174 - DNA, 9 bp, Artificial Sequence
  Synthetic oligonucleotide
aagtgagga

SEQ ID NO: 4175 - DNA, 9 bp, Artificial Sequence
  Synthetic oligonucleotide
tagtgagga

SEQ ID NO: 4176 - DNA, 9 bp, Artificial Sequence
  Synthetic oligonucleotide
gagtgagca

SEQ ID NO: 4177 - DNA, 9 bp, Artificial Sequence
  Synthetic oligonucleotide
gagggagga

SEQ ID NO: 4178 - DNA, 9 bp, Artificial Sequence
  Synthetic oligonucleotide
gagtgaggg

SEQ ID NO: 4179 - DNA, 9 bp, Artificial Sequence
  Synthetic oligonucleotide
gagtgaggg

SEQ ID NO: 4180 - DNA, 9 bp, Artificial Sequence
  Synthetic oligonucleotide
gagtgaggc

SEQ ID NO: 4181 - DNA, 9 bp, Artificial Sequence
  Synthetic oligonucleotide
aagtgagga

SEQ ID NO: 4182 - DNA, 9 bp, Artificial Sequence
  Synthetic oligonucleotide
gagtgaggg

SEQ ID NO: 4183 - DNA, 9 bp, Artificial Sequence
  Synthetic oligonucleotide
aagtgagga

SEQ ID NO: 4184 - DNA, 9 bp, Artificial Sequence
  Synthetic oligonucleotide
gagtgaggg

SEQ ID NO: 4185 - DNA, 9 bp, Artificial Sequence
  Synthetic oligonucleotide
gagtgaggg

SEQ ID NO: 4186 - DNA, 9 bp, Artificial Sequence
  Synthetic oligonucleotide
gagtgaggg

SEQ ID NO: 4187 - DNA, 9 bp, Artificial Sequence
  Synthetic oligonucleotide
gagtgaggg

SEQ ID NO: 4188 - DNA, 9 bp, Artificial Sequence
  Synthetic oligonucleotide
gagtgaggg

SEQ ID NO: 4189 - DNA, 9 bp, Artificial Sequence
  Synthetic oligonucleotide
gagtgaggg

SEQ ID NO: 4190 - DNA, 9 bp, Artificial Sequence
  Synthetic oligonucleotide
aagtgagga

SEQ ID NO: 4191 - DNA, 9 bp, Artificial Sequence
  Synthetic oligonucleotide
aagtgagga

SEQ ID NO: 4192 - DNA, 9 bp, Artificial Sequence
  Synthetic oligonucleotide
gagtgagaa

SEQ ID NO: 4193 - DNA, 9 bp, Artificial Sequence
  Synthetic oligonucleotide
gagtgaggg

SEQ ID NO: 4194 - DNA, 9 bp, Artificial Sequence
  Synthetic oligonucleotide
gagtgagaa

SEQ ID NO: 4195 - DNA, 9 bp, Artificial Sequence
  Synthetic oligonucleotide
gagtgaggg

SEQ ID NO: 4196 - DNA, 9 bp, Artificial Sequence
  Synthetic oligonucleotide
gagtgaggg

SEQ ID NO: 4197 - DNA, 9 bp, Artificial Sequence
  Synthetic oligonucleotide
aagtgagga

SEQ ID NO: 4198 - DNA, 9 bp, Artificial Sequence
  Synthetic oligonucleotide
gagtgaggc

SEQ ID NO: 4199 - DNA, 9 bp, Artificial Sequence
  Synthetic oligonucleotide
gagtgaggt

SEQ ID NO: 4200 - DNA, 9 bp, Artificial Sequence
  Synthetic oligonucleotide
gagtgaggc

SEQ ID NO: 4201 - DNA, 9 bp, Artificial Sequence
  Synthetic oligonucleotide
cagtgagga

SEQ ID NO: 4202 - DNA, 9 bp, Artificial Sequence
  Synthetic oligonucleotide
tagtgagga

SEQ ID NO: 4203 - DNA, 9 bp, Artificial Sequence
  Synthetic oligonucleotide
gagagagga

SEQ ID NO: 4204 - DNA, 9 bp, Artificial Sequence
  Synthetic oligonucleotide
gagtgaggg

SEQ ID NO: 4205 - DNA, 9 bp, Artificial Sequence
  Synthetic oligonucleotide
gagtgaggg

SEQ ID NO: 4206 - DNA, 9 bp, Artificial Sequence
  Synthetic oligonucleotide
gagggagga

SEQ ID NO: 4207 - DNA, 9 bp, Artificial Sequence
  Synthetic oligonucleotide
cagtgagga

SEQ ID NO: 4208 - DNA, 9 bp, Artificial Sequence
  Synthetic oligonucleotide
gagtgaggg

SEQ ID NO: 4209 - DNA, 9 bp, Artificial Sequence
  Synthetic oligonucleotide
gagtgaggc

SEQ ID NO: 4210 - DNA, 9 bp, Artificial Sequence
  Synthetic oligonucleotide
gagggagga

SEQ ID NO: 4211 - DNA, 9 bp, Artificial Sequence
  Synthetic oligonucleotide
gagtgaggt

SEQ ID NO: 4212 - DNA, 9 bp, Artificial Sequence
  Synthetic oligonucleotide
aagtgagga

SEQ ID NO: 4213 - DNA, 9 bp, Artificial Sequence
  Synthetic oligonucleotide
gagtgaggg

SEQ ID NO: 4214 - DNA, 9 bp, Artificial Sequence
  Synthetic oligonucleotide
gagtgaggg

SEQ ID NO: 4215 - DNA, 9 bp, Artificial Sequence
  Synthetic oligonucleotide
aagtgagga

SEQ ID NO: 4216 - DNA, 9 bp, Artificial Sequence
  Synthetic oligonucleotide
gagtgagaa

SEQ ID NO: 4217 - DNA, 9 bp, Artificial Sequence
  Synthetic oligonucleotide
gagtgaggt

SEQ ID NO: 4218 - DNA, 9 bp, Artificial Sequence
  Synthetic oligonucleotide
gagagagga

SEQ ID NO: 4219 - DNA, 9 bp, Artificial Sequence
  Synthetic oligonucleotide
gagtgaggg

SEQ ID NO: 4220 - DNA, 9 bp, Artificial Sequence
  Synthetic oligonucleotide
gagtgagaa

SEQ ID NO: 4221 - DNA, 9 bp, Artificial Sequence
  Synthetic oligonucleotide
cagtgagga

SEQ ID NO: 4222 - DNA, 9 bp, Artificial Sequence
  Synthetic oligonucleotide
cagtgagga

SEQ ID NO: 4223 - DNA, 9 bp, Artificial Sequence
  Synthetic oligonucleotide
gagtgaggt

SEQ ID NO: 4224 - DNA, 9 bp, Artificial Sequence
  Synthetic oligonucleotide
gagtgaggg

SEQ ID NO: 4225 - DNA, 9 bp, Artificial Sequence
  Synthetic oligonucleotide
gagtgaggg

SEQ ID NO: 4226 - DNA, 9 bp, Artificial Sequence
  Synthetic oligonucleotide
gagtgaggg

SEQ ID NO: 4227 - DNA, 9 bp, Artificial Sequence
  Synthetic oligonucleotide
gagtgaggc

SEQ ID NO: 4228 - DNA, 9 bp, Artificial Sequence
  Synthetic oligonucleotide
gagtgaggc

SEQ ID NO: 4229 - DNA, 9 bp, Artificial Sequence
  Synthetic oligonucleotide
gagggagga

SEQ ID NO: 4230 - DNA, 9 bp, Artificial Sequence
  Synthetic oligonucleotide
gagtgaggg

SEQ ID NO: 4231 - DNA, 9 bp, Artificial Sequence
  Synthetic oligonucleotide
gggtgagga

SEQ ID NO: 4232 - DNA, 9 bp, Artificial Sequence
  Synthetic oligonucleotide
gagtgggga

SEQ ID NO: 4233 - DNA, 9 bp, Artificial Sequence
  Synthetic oligonucleotide
gagtgaggc

SEQ ID NO: 4234 - DNA, 9 bp, Artificial Sequence
  Synthetic oligonucleotide
gagtgagca

SEQ ID NO: 4235 - DNA, 9 bp, Artificial Sequence
  Synthetic oligonucleotide
gagtgagaa

SEQ ID NO: 4236 - DNA, 9 bp, Artificial Sequence
  Synthetic oligonucleotide
gagtgaggc

SEQ ID NO: 4237 - DNA, 9 bp, Artificial Sequence
  Synthetic oligonucleotide
gagtgaggt

SEQ ID NO: 4238 - DNA, 9 bp, Artificial Sequence
  Synthetic oligonucleotide
gagtgagga

SEQ ID NO: 4239 - DNA, 9 bp, Artificial Sequence
  Synthetic oligonucleotide
gagtgagga

SEQ ID NO: 4240 - DNA, 9 bp, Artificial Sequence
  Synthetic oligonucleotide
gagtgagga

SEQ ID NO: 4241 - DNA, 9 bp, Artificial Sequence
  Synthetic oligonucleotide
gagtgagga

SEQ ID NO: 4242 - DNA, 9 bp, Artificial Sequence
  Synthetic oligonucleotide
gagtgagga

SEQ ID NO: 4243 - DNA, 9 bp, Artificial Sequence
  Synthetic oligonucleotide
gagtgagga

SEQ ID NO: 4244 - DNA, 9 bp, Artificial Sequence
  Synthetic oligonucleotide
gagtgagga

SEQ ID NO: 4245 - DNA, 9 bp, Artificial Sequence
  Synthetic oligonucleotide
gagtgagga

SEQ ID NO: 4246 - DNA, 9 bp, Artificial Sequence
  Synthetic oligonucleotide
gagtgagga

SEQ ID NO: 4247 - DNA, 9 bp, Artificial Sequence
  Synthetic oligonucleotide
gagtgagga

SEQ ID NO: 4248 - DNA, 9 bp, Artificial Sequence
  Synthetic oligonucleotide
gagtgagga

SEQ ID NO: 4249 - DNA, 9 bp, Artificial Sequence
  Synthetic oligonucleotide
gagtgagga

SEQ ID NO: 4250 - DNA, 9 bp, Artificial Sequence
  Synthetic oligonucleotide
gagtgagga

SEQ ID NO: 4251 - DNA, 9 bp, Artificial Sequence
  Synthetic oligonucleotide
gagtgagga

SEQ ID NO: 4252 - DNA, 9 bp, Artificial Sequence
  Synthetic oligonucleotide
gagtgagga

SEQ ID NO: 4253 - DNA, 9 bp, Artificial Sequence
  Synthetic oligonucleotide
gagtgagga

SEQ ID NO: 4254 - DNA, 9 bp, Artificial Sequence
  Synthetic oligonucleotide
gagtgagga

SEQ ID NO: 4255 - DNA, 9 bp, Artificial Sequence
  Synthetic oligonucleotide
gagtgagga

SEQ ID NO: 4256 - DNA, 9 bp, Artificial Sequence
  Synthetic oligonucleotide
gagtgagga

SEQ ID NO: 4257 - DNA, 9 bp, Artificial Sequence
  Synthetic oligonucleotide
gagtgagga

SEQ ID NO: 4258 - DNA, 9 bp, Artificial Sequence
  Synthetic oligonucleotide
gagtgagga

SEQ ID NO: 4259 - DNA, 9 bp, Artificial Sequence
  Synthetic oligonucleotide
gagtgagga

SEQ ID NO: 4260 - DNA, 9 bp, Artificial Sequence
  Synthetic oligonucleotide
gagtgagga

SEQ ID NO: 4261 - DNA, 9 bp, Artificial Sequence
  Synthetic oligonucleotide
gagtgagga

SEQ ID NO: 4262 - DNA, 9 bp, Artificial Sequence
  Synthetic oligonucleotide
gagtgagga

SEQ ID NO: 4263 - DNA, 9 bp, Artificial Sequence
  Synthetic oligonucleotide
gagtgagga

SEQ ID NO: 4264 - DNA, 9 bp, Artificial Sequence
  Synthetic oligonucleotide
gagtgagga

SEQ ID NO: 4265 - DNA, 9 bp, Artificial Sequence
  Synthetic oligonucleotide
gagtgagga

SEQ ID NO: 4266 - DNA, 9 bp, Artificial Sequence
  Synthetic oligonucleotide
gagtgagga

SEQ ID NO: 4267 - DNA, 9 bp, Artificial Sequence
  Synthetic oligonucleotide
gagtgagga

SEQ ID NO: 4268 - DNA, 9 bp, Artificial Sequence
  Synthetic oligonucleotide
gagtgagga

SEQ ID NO: 4269 - DNA, 9 bp, Artificial Sequence
  Synthetic oligonucleotide
gagtgagga

SEQ ID NO: 4270 - DNA, 9 bp, Artificial Sequence
  Synthetic oligonucleotide
gagtgagga

SEQ ID NO: 4271 - DNA, 9 bp, Artificial Sequence
  Synthetic oligonucleotide
gagtgagga

SEQ ID NO: 4272 - DNA, 9 bp, Artificial Sequence
  Synthetic oligonucleotide
gagtgagga

SEQ ID NO: 4273 - DNA, 9 bp, Artificial Sequence
  Synthetic oligonucleotide
gagtgagga

SEQ ID NO: 4274 - DNA, 9 bp, Artificial Sequence
  Synthetic oligonucleotide
gagtgagga

SEQ ID NO: 4275 - DNA, 9 bp, Artificial Sequence
  Synthetic oligonucleotide
gagtgagga

SEQ ID NO: 4276 - DNA, 9 bp, Artificial Sequence
  Synthetic oligonucleotide
gagtgagga

SEQ ID NO: 4277 - DNA, 9 bp, Artificial Sequence
  Synthetic oligonucleotide
gagtgagga

SEQ ID NO: 4278 - DNA, 9 bp, Artificial Sequence
  Synthetic oligonucleotide
gagtgagga

SEQ ID NO: 4279 - DNA, 9 bp, Artificial Sequence
  Synthetic oligonucleotide
gagtgagga

SEQ ID NO: 4280 - DNA, 9 bp, Artificial Sequence
  Synthetic oligonucleotide
gagtgagga

SEQ ID NO: 4281 - DNA, 9 bp, Artificial Sequence
  Synthetic oligonucleotide
gagtgagga

SEQ ID NO: 4282 - DNA, 9 bp, Artificial Sequence
  Synthetic oligonucleotide
gagtgagga

SEQ ID NO: 4283 - DNA, 9 bp, Artificial Sequence
  Synthetic oligonucleotide
gagtgagga

SEQ ID NO: 4284 - DNA, 9 bp, Artificial Sequence
  Synthetic oligonucleotide
gagtgagga

SEQ ID NO: 4285 - DNA, 9 bp, Artificial Sequence
  Synthetic oligonucleotide
gagtgagga

SEQ ID NO: 4286 - DNA, 9 bp, Artificial Sequence
  Synthetic oligonucleotide
gagtgagga

SEQ ID NO: 4287 - DNA, 9 bp, Artificial Sequence
  Synthetic oligonucleotide
gagtgagga

SEQ ID NO: 4288 - DNA, 9 bp, Artificial Sequence
  Synthetic oligonucleotide
gagtgagga

SEQ ID NO: 4289 - DNA, 9 bp, Artificial Sequence
  Synthetic oligonucleotide
gagtgagga

SEQ ID NO: 4290 - DNA, 9 bp, Artificial Sequence
  Synthetic oligonucleotide
gagtgagga

SEQ ID NO: 4291 - DNA, 9 bp, Artificial Sequence
  Synthetic oligonucleotide
gagtgagga

SEQ ID NO: 4292 - DNA, 9 bp, Artificial Sequence
  Synthetic oligonucleotide
gagtgagga

SEQ ID NO: 4293 - DNA, 9 bp, Artificial Sequence
  Synthetic oligonucleotide
gagtgagga

SEQ ID NO: 4294 - DNA, 9 bp, Artificial Sequence
  Synthetic oligonucleotide
gagtgagga

SEQ ID NO: 4295 - DNA, 9 bp, Artificial Sequence
  Synthetic oligonucleotide
gagtgagga

SEQ ID NO: 4296 - DNA, 9 bp, Artificial Sequence
  Synthetic oligonucleotide
gagtgagga

SEQ ID NO: 4297 - DNA, 9 bp, Artificial Sequence
  Synthetic oligonucleotide
gagtgagga

SEQ ID NO: 4298 - DNA, 9 bp, Artificial Sequence
  Synthetic oligonucleotide
gagtgagga

SEQ ID NO: 4299 - DNA, 9 bp, Artificial Sequence
  Synthetic oligonucleotide
gagtgagga

SEQ ID NO: 4300 - DNA, 9 bp, Artificial Sequence
  Synthetic oligonucleotide
gagtgagga

SEQ ID NO: 4301 - DNA, 9 bp, Artificial Sequence
  Synthetic oligonucleotide
gagtgagga

SEQ ID NO: 4302 - DNA, 9 bp, Artificial Sequence
  Synthetic oligonucleotide
gagtgagga

SEQ ID NO: 4303 - DNA, 9 bp, Artificial Sequence
  Synthetic oligonucleotide
gagtgagga

SEQ ID NO: 4304 - DNA, 9 bp, Artificial Sequence
  Synthetic oligonucleotide
gagtgagga

SEQ ID NO: 4305 - DNA, 9 bp, Artificial Sequence
  Synthetic oligonucleotide
gagtgagga

SEQ ID NO: 4306 - DNA, 9 bp, Artificial Sequence
  Synthetic oligonucleotide
gagtgagga

SEQ ID NO: 4307 - DNA, 9 bp, Artificial Sequence
  Synthetic oligonucleotide
gagtgagga

SEQ ID NO: 4308 - DNA, 9 bp, Artificial Sequence
  Synthetic oligonucleotide
gagtgagga

SEQ ID NO: 4309 - DNA, 9 bp, Artificial Sequence
  Synthetic oligonucleotide
gagtgagga

SEQ ID NO: 4310 - DNA, 9 bp, Artificial Sequence
  Synthetic oligonucleotide
gagtgagga

SEQ ID NO: 4311 - DNA, 9 bp, Artificial Sequence
  Synthetic oligonucleotide
gagtgagga

SEQ ID NO: 4312 - DNA, 9 bp, Artificial Sequence
  Synthetic oligonucleotide
gagtgagga

SEQ ID NO: 4313 - DNA, 9 bp, Artificial Sequence
  Synthetic oligonucleotide
gagtgagga

SEQ ID NO: 4314 - DNA, 9 bp, Artificial Sequence
  Synthetic oligonucleotide
gagtgagga

SEQ ID NO: 4315 - DNA, 9 bp, Artificial Sequence
  Synthetic oligonucleotide
gagtgagga

SEQ ID NO: 4316 - DNA, 9 bp, Artificial Sequence
  Synthetic oligonucleotide
gagtgagga

SEQ ID NO: 4317 - DNA, 9 bp, Artificial Sequence
  Synthetic oligonucleotide
gagtgagga

SEQ ID NO: 4318 - DNA, 9 bp, Artificial Sequence
  Synthetic oligonucleotide
gagtgagga

SEQ ID NO: 4319 - DNA, 9 bp, Artificial Sequence
  Synthetic oligonucleotide
gagtgagga

SEQ ID NO: 4320 - DNA, 9 bp, Artificial Sequence
  Synthetic oligonucleotide
gagtgagga

SEQ ID NO: 4321 - DNA, 9 bp, Artificial Sequence
  Synthetic oligonucleotide
gagtgagga

SEQ ID NO: 4322 - DNA, 9 bp, Artificial Sequence
  Synthetic oligonucleotide
gagtgagga

SEQ ID NO: 4323 - DNA, 9 bp, Artificial Sequence
  Synthetic oligonucleotide
gagtgagga

SEQ ID NO: 4324 - DNA, 9 bp, Artificial Sequence
  Synthetic oligonucleotide
gagtgagga

SEQ ID NO: 4325 - DNA, 9 bp, Artificial Sequence
  Synthetic oligonucleotide
gagtgagga

SEQ ID NO: 4326 - DNA, 9 bp, Artificial Sequence
  Synthetic oligonucleotide
gagtgagga

SEQ ID NO: 4327 - DNA, 9 bp, Artificial Sequence
  Synthetic oligonucleotide
gagtgagga

SEQ ID NO: 4328 - DNA, 9 bp, Artificial Sequence
  Synthetic oligonucleotide
gagtgagga

SEQ ID NO: 4329 - DNA, 9 bp, Artificial Sequence
  Synthetic oligonucleotide
gagtgagga

SEQ ID NO: 4330 - DNA, 9 bp, Artificial Sequence
  Synthetic oligonucleotide
gagtgagga

SEQ ID NO: 4331 - DNA, 9 bp, Artificial Sequence
  Synthetic oligonucleotide
gagtgagga

SEQ ID NO: 4332 - DNA, 9 bp, Artificial Sequence
  Synthetic oligonucleotide
gagtgagga

SEQ ID NO: 4333 - DNA, 9 bp, Artificial Sequence
  Synthetic oligonucleotide
gagtgagga

SEQ ID NO: 4334 - DNA, 9 bp, Artificial Sequence
  Synthetic oligonucleotide
gagtgagga

SEQ ID NO: 4335 - DNA, 9 bp, Artificial Sequence
  Synthetic oligonucleotide
gagtgagga

SEQ ID NO: 4336 - DNA, 9 bp, Artificial Sequence
  Synthetic oligonucleotide
gagtgagga

SEQ ID NO: 4337 - DNA, 9 bp, Artificial Sequence
  Synthetic oligonucleotide
gagtgagga

SEQ ID NO: 4338 - DNA, 9 bp, Artificial Sequence
  Synthetic oligonucleotide
gagtgagga

SEQ ID NO: 4339 - DNA, 9 bp, Artificial Sequence
  Synthetic oligonucleotide
gagtgagga

SEQ ID NO: 4340 - DNA, 9 bp, Artificial Sequence
  Synthetic oligonucleotide
gagtgagga

SEQ ID NO: 4341 - DNA, 9 bp, Artificial Sequence
  Synthetic oligonucleotide
gagtgagga

SEQ ID NO: 4342 - DNA, 9 bp, Artificial Sequence
  Synthetic oligonucleotide
gagtgagga

SEQ ID NO: 4343 - DNA, 9 bp, Artificial Sequence
  Synthetic oligonucleotide
gagtgagga

SEQ ID NO: 4344 - DNA, 9 bp, Artificial Sequence
  Synthetic oligonucleotide
gagtgagga

SEQ ID NO: 4345 - DNA, 9 bp, Artificial Sequence
  Synthetic oligonucleotide
gagtgagga

SEQ ID NO: 4346 - DNA, 9 bp, Artificial Sequence
  Synthetic oligonucleotide
gagtgagga

SEQ ID NO: 4347 - DNA, 9 bp, Artificial Sequence
  Synthetic oligonucleotide
gagtgagga

SEQ ID NO: 4348 - DNA, 9 bp, Artificial Sequence
  Synthetic oligonucleotide
gagtgagga

SEQ ID NO: 4349 - DNA, 9 bp, Artificial Sequence
  Synthetic oligonucleotide
gagtgagga

SEQ ID NO: 4350 - DNA, 9 bp, Artificial Sequence
  Synthetic oligonucleotide
tagcaaggt

SEQ ID NO: 4351 - DNA, 9 bp, Artificial Sequence
  Synthetic oligonucleotide
gagacaagt

SEQ ID NO: 4352 - DNA, 9 bp, Artificial Sequence
  Synthetic oligonucleotide
gagaggcgc

SEQ ID NO: 4353 - DNA, 9 bp, Artificial Sequence
  Synthetic oligonucleotide
gggtgagtc

SEQ ID NO: 4354 - DNA, 9 bp, Artificial Sequence
  Synthetic oligonucleotide
gagaaaggt

SEQ ID NO: 4355 - DNA, 9 bp, Artificial Sequence
  Synthetic oligonucleotide
tggggagga

SEQ ID NO: 4356 - DNA, 9 bp, Artificial Sequence
  Synthetic oligonucleotide
aagtgtggg

SEQ ID NO: 4357 - DNA, 9 bp, Artificial Sequence
  Synthetic oligonucleotide
gtgtaaggc

SEQ ID NO: 4358 - DNA, 9 bp, Artificial Sequence
  Synthetic oligonucleotide
gagtcacgc

SEQ ID NO: 4359 - DNA, 9 bp, Artificial Sequence
  Synthetic oligonucleotide
gtgtgtgaa

SEQ ID NO: 4360 - DNA, 9 bp, Artificial Sequence
  Synthetic oligonucleotide
gtgtgtgaa

SEQ ID NO: 4361 - DNA, 9 bp, Artificial Sequence
  Synthetic oligonucleotide
aagtgtggc

SEQ ID NO: 4362 - DNA, 9 bp, Artificial Sequence
  Synthetic oligonucleotide
aggtgagca

SEQ ID NO: 4363 - DNA, 9 bp, Artificial Sequence
  Synthetic oligonucleotide
gtgtgagtc

SEQ ID NO: 4364 - DNA, 9 bp, Artificial Sequence
  Synthetic oligonucleotide
tagtgaata

SEQ ID NO: 4365 - DNA, 9 bp, Artificial Sequence
  Synthetic oligonucleotide
gtgcgatga

SEQ ID NO: 4366 - DNA, 9 bp, Artificial Sequence
  Synthetic oligonucleotide
gagtgttgc

SEQ ID NO: 4367 - DNA, 9 bp, Artificial Sequence
  Synthetic oligonucleotide
atgtgaggc

SEQ ID NO: 4368 - DNA, 9 bp, Artificial Sequence
  Synthetic oligonucleotide
gagtgacag

SEQ ID NO: 4369 - DNA, 9 bp, Artificial Sequence
  Synthetic oligonucleotide
gtgtgcggt

SEQ ID NO: 4370 - DNA, 9 bp, Artificial Sequence
  Synthetic oligonucleotide
aagtgtggc

SEQ ID NO: 4371 - DNA, 9 bp, Artificial Sequence
  Synthetic oligonucleotide
gagtaaggc

SEQ ID NO: 4372 - DNA, 9 bp, Artificial Sequence
  Synthetic oligonucleotide
gagtgagac

SEQ ID NO: 4373 - DNA, 9 bp, Artificial Sequence
  Synthetic oligonucleotide
gagtgagtc

SEQ ID NO: 4374 - DNA, 9 bp, Artificial Sequence
  Synthetic oligonucleotide
tagtgaggg

SEQ ID NO: 4375 - DNA, 9 bp, Artificial Sequence
  Synthetic oligonucleotide
tagtgaggg

SEQ ID NO: 4376 - DNA, 9 bp, Artificial Sequence
  Synthetic oligonucleotide
gagtgagag

SEQ ID NO: 4377 - DNA, 9 bp, Artificial Sequence
  Synthetic oligonucleotide
tagtgaggg

SEQ ID NO: 4378 - DNA, 9 bp, Artificial Sequence
  Synthetic oligonucleotide
gagtgagag

SEQ ID NO: 4379 - DNA, 9 bp, Artificial Sequence
  Synthetic oligonucleotide
tagtgaggg

SEQ ID NO: 4380 - DNA, 9 bp, Artificial Sequence
  Synthetic oligonucleotide
tagtgaggg

SEQ ID NO: 4381 - DNA, 9 bp, Artificial Sequence
  Synthetic oligonucleotide
gagtgagag

SEQ ID NO: 4382 - DNA, 9 bp, Artificial Sequence
  Synthetic oligonucleotide
gagtgagag

SEQ ID NO: 4383 - DNA, 9 bp, Artificial Sequence
  Synthetic oligonucleotide
gtgtgaggc

SEQ ID NO: 4384 - DNA, 9 bp, Artificial Sequence
  Synthetic oligonucleotide
tagtgaggg

SEQ ID NO: 4385 - DNA, 9 bp, Artificial Sequence
  Synthetic oligonucleotide
aagtgaggg

SEQ ID NO: 4386 - DNA, 9 bp, Artificial Sequence
  Synthetic oligonucleotide
gagtgagtg

SEQ ID NO: 4387 - DNA, 9 bp, Artificial Sequence
  Synthetic oligonucleotide
ttgtgagga

SEQ ID NO: 4388 - DNA, 9 bp, Artificial Sequence
  Synthetic oligonucleotide
tagtgaggg

SEQ ID NO: 4389 - DNA, 9 bp, Artificial Sequence
  Synthetic oligonucleotide
aagtgaggg

SEQ ID NO: 4390 - DNA, 9 bp, Artificial Sequence
  Synthetic oligonucleotide
gagtgagag

SEQ ID NO: 4391 - DNA, 9 bp, Artificial Sequence
  Synthetic oligonucleotide
tagtgaggg

SEQ ID NO: 4392 - DNA, 9 bp, Artificial Sequence
  Synthetic oligonucleotide
tagtgaggg

SEQ ID NO: 4393 - DNA, 9 bp, Artificial Sequence
  Synthetic oligonucleotide
gagtgagtc

SEQ ID NO: 4394 - DNA, 9 bp, Artificial Sequence
  Synthetic oligonucleotide
gagtgagtc

SEQ ID NO: 4395 - DNA, 9 bp, Artificial Sequence
  Synthetic oligonucleotide
gagtgagac

SEQ ID NO: 4396 - DNA, 9 bp, Artificial Sequence
  Synthetic oligonucleotide
tagtgaggg

SEQ ID NO: 4397 - DNA, 9 bp, Artificial Sequence
  Synthetic oligonucleotide
gagtgagtc

SEQ ID NO: 4398 - DNA, 9 bp, Artificial Sequence
  Synthetic oligonucleotide
tagtgaggt

SEQ ID NO: 4399 - DNA, 9 bp, Artificial Sequence
  Synthetic oligonucleotide
gagtaaggg

SEQ ID NO: 4400 - DNA, 9 bp, Artificial Sequence
  Synthetic oligonucleotide
aagtgaggt

SEQ ID NO: 4401 - DNA, 9 bp, Artificial Sequence
  Synthetic oligonucleotide
gagtgagtc

SEQ ID NO: 4402 - DNA, 9 bp, Artificial Sequence
  Synthetic oligonucleotide
gagtgagag

SEQ ID NO: 4403 - DNA, 9 bp, Artificial Sequence
  Synthetic oligonucleotide
aagtgaggc

SEQ ID NO: 4404 - DNA, 9 bp, Artificial Sequence
  Synthetic oligonucleotide
tagtgaggg

SEQ ID NO: 4405 - DNA, 9 bp, Artificial Sequence
  Synthetic oligonucleotide
aagtgaggg

SEQ ID NO: 4406 - DNA, 9 bp, Artificial Sequence
  Synthetic oligonucleotide
tagtgaggg

SEQ ID NO: 4407 - DNA, 9 bp, Artificial Sequence
  Synthetic oligonucleotide
tagtgaggg

SEQ ID NO: 4408 - DNA, 9 bp, Artificial Sequence
  Synthetic oligonucleotide
gagtgagag

SEQ ID NO: 4409 - DNA, 9 bp, Artificial Sequence
  Synthetic oligonucleotide
tagtgaggg

SEQ ID NO: 4410 - DNA, 9 bp, Artificial Sequence
  Synthetic oligonucleotide
gagtgagat

SEQ ID NO: 4411 - DNA, 9 bp, Artificial Sequence
  Synthetic oligonucleotide
gagtgagag

SEQ ID NO: 4412 - DNA, 9 bp, Artificial Sequence
  Synthetic oligonucleotide
gagtgaaaa

SEQ ID NO: 4413 - DNA, 9 bp, Artificial Sequence
  Synthetic oligonucleotide
tagtgaggg

SEQ ID NO: 4414 - DNA, 9 bp, Artificial Sequence
  Synthetic oligonucleotide
gagtgagag

SEQ ID NO: 4415 - DNA, 9 bp, Artificial Sequence
  Synthetic oligonucleotide
gagtgagtc

SEQ ID NO: 4416 - DNA, 9 bp, Artificial Sequence
  Synthetic oligonucleotide
tagtgagaa

SEQ ID NO: 4417 - DNA, 9 bp, Artificial Sequence
  Synthetic oligonucleotide
cagtgaggg

SEQ ID NO: 4418 - DNA, 9 bp, Artificial Sequence
  Synthetic oligonucleotide
gagtgagag

SEQ ID NO: 4419 - DNA, 9 bp, Artificial Sequence
  Synthetic oligonucleotide
gagtgagtc

SEQ ID NO: 4420 - DNA, 9 bp, Artificial Sequence
  Synthetic oligonucleotide
tagtgaggg

SEQ ID NO: 4421 - DNA, 9 bp, Artificial Sequence
  Synthetic oligonucleotide
tagtgaggg

SEQ ID NO: 4422 - DNA, 9 bp, Artificial Sequence
  Synthetic oligonucleotide
gagtgtggg

SEQ ID NO: 4423 - DNA, 9 bp, Artificial Sequence
  Synthetic oligonucleotide
gagtgaggg

SEQ ID NO: 4424 - DNA, 9 bp, Artificial Sequence
  Synthetic oligonucleotide
gagtgaggc

SEQ ID NO: 4425 - DNA, 9 bp, Artificial Sequence
  Synthetic oligonucleotide
gagtgaggg

SEQ ID NO: 4426 - DNA, 9 bp, Artificial Sequence
  Synthetic oligonucleotide
gagtgaggt

SEQ ID NO: 4427 - DNA, 9 bp, Artificial Sequence
  Synthetic oligonucleotide
gagtgaggt

SEQ ID NO: 4428 - DNA, 9 bp, Artificial Sequence
  Synthetic oligonucleotide
gagtgaggc

SEQ ID NO: 4429 - DNA, 9 bp, Artificial Sequence
  Synthetic oligonucleotide
gagtgaggc

SEQ ID NO: 4430 - DNA, 9 bp, Artificial Sequence
  Synthetic oligonucleotide
gagtgaggg

SEQ ID NO: 4431 - DNA, 9 bp, Artificial Sequence
  Synthetic oligonucleotide
gagtgaggg

SEQ ID NO: 4432 - DNA, 9 bp, Artificial Sequence
  Synthetic oligonucleotide
gagtgaggc

SEQ ID NO: 4433 - DNA, 9 bp, Artificial Sequence
  Synthetic oligonucleotide
gagtgaggg

SEQ ID NO: 4434 - DNA, 9 bp, Artificial Sequence
  Synthetic oligonucleotide
gagtgaggc

SEQ ID NO: 4435 - DNA, 9 bp, Artificial Sequence
  Synthetic oligonucleotide
gagtgaggg

SEQ ID NO: 4436 - DNA, 9 bp, Artificial Sequence
  Synthetic oligonucleotide
gagtgaggg

SEQ ID NO: 4437 - DNA, 9 bp, Artificial Sequence
  Synthetic oligonucleotide
gagtgaggg

SEQ ID NO: 4438 - DNA, 9 bp, Artificial Sequence
  Synthetic oligonucleotide
gagtgaggt

SEQ ID NO: 4439 - DNA, 9 bp, Artificial Sequence
  Synthetic oligonucleotide
gagtgaggt

SEQ ID NO: 4440 - DNA, 9 bp, Artificial Sequence
  Synthetic oligonucleotide
gagtgaggc

SEQ ID NO: 4441 - DNA, 9 bp, Artificial Sequence
  Synthetic oligonucleotide
gagtgaggt

SEQ ID NO: 4442 - DNA, 9 bp, Artificial Sequence
  Synthetic oligonucleotide
gagtgaggg

SEQ ID NO: 4443 - DNA, 9 bp, Artificial Sequence
  Synthetic oligonucleotide
gagtgaggt

SEQ ID NO: 4444 - DNA, 9 bp, Artificial Sequence
  Synthetic oligonucleotide
gagtgaggg

SEQ ID NO: 4445 - DNA, 9 bp, Artificial Sequence
  Synthetic oligonucleotide
gagtgaggc

SEQ ID NO: 4446 - DNA, 9 bp, Artificial Sequence
  Synthetic oligonucleotide
gagtgaggc

SEQ ID NO: 4447 - DNA, 9 bp, Artificial Sequence
  Synthetic oligonucleotide
gagtgaggt

SEQ ID NO: 4448 - DNA, 9 bp, Artificial Sequence
  Synthetic oligonucleotide
gagtgaggt

SEQ ID NO: 4449 - DNA, 9 bp, Artificial Sequence
  Synthetic oligonucleotide
gagtgaggt

SEQ ID NO: 4450 - DNA, 9 bp, Artificial Sequence
  Synthetic oligonucleotide
gagtgaggg

SEQ ID NO: 4451 - DNA, 9 bp, Artificial Sequence
  Synthetic oligonucleotide
gagtgaggc

SEQ ID NO: 4452 - DNA, 9 bp, Artificial Sequence
  Synthetic oligonucleotide
gagtgaggt

SEQ ID NO: 4453 - DNA, 9 bp, Artificial Sequence
  Synthetic oligonucleotide
gagtgaggg

SEQ ID NO: 4454 - DNA, 9 bp, Artificial Sequence
  Synthetic oligonucleotide
gagtgaggt

SEQ ID NO: 4455 - DNA, 9 bp, Artificial Sequence
  Synthetic oligonucleotide
gagtgaggt

SEQ ID NO: 4456 - DNA, 9 bp, Artificial Sequence
  Synthetic oligonucleotide
gagtgaggt

SEQ ID NO: 4457 - DNA, 9 bp, Artificial Sequence
  Synthetic oligonucleotide
gagtgaggt

SEQ ID NO: 4458 - DNA, 9 bp, Artificial Sequence
  Synthetic oligonucleotide
gagtgagaa

SEQ ID NO: 4459 - DNA, 9 bp, Artificial Sequence
  Synthetic oligonucleotide
gagtgaggt

SEQ ID NO: 4460 - DNA, 9 bp, Artificial Sequence
  Synthetic oligonucleotide
gagtgaggt

SEQ ID NO: 4461 - DNA, 9 bp, Artificial Sequence
  Synthetic oligonucleotide
gagtgaggg

SEQ ID NO: 4462 - DNA, 9 bp, Artificial Sequence
  Synthetic oligonucleotide
gagtgaggc

SEQ ID NO: 4463 - DNA, 9 bp, Artificial Sequence
  Synthetic oligonucleotide
gagtgaggg

SEQ ID NO: 4464 - DNA, 9 bp, Artificial Sequence
  Synthetic oligonucleotide
gagtgaggg

SEQ ID NO: 4465 - DNA, 9 bp, Artificial Sequence
  Synthetic oligonucleotide
gagtgaggg

SEQ ID NO: 4466 - DNA, 9 bp, Artificial Sequence
  Synthetic oligonucleotide
gagtgaggg

SEQ ID NO: 4467 - DNA, 9 bp, Artificial Sequence
  Synthetic oligonucleotide
gagtgaggg

SEQ ID NO: 4468 - DNA, 9 bp, Artificial Sequence
  Synthetic oligonucleotide
gagtgaggg

SEQ ID NO: 4469 - DNA, 9 bp, Artificial Sequence
  Synthetic oligonucleotide
gagtgaggc

SEQ ID NO: 4470 - DNA, 9 bp, Artificial Sequence
  Synthetic oligonucleotide
gagtgaggt

SEQ ID NO: 4471 - DNA, 9 bp, Artificial Sequence
  Synthetic oligonucleotide
gagtgaggt

SEQ ID NO: 4472 - DNA, 9 bp, Artificial Sequence
  Synthetic oligonucleotide
gagtgaggg

SEQ ID NO: 4473 - DNA, 9 bp, Artificial Sequence
  Synthetic oligonucleotide
gagtgaggc

SEQ ID NO: 4474 - DNA, 9 bp, Artificial Sequence
  Synthetic oligonucleotide
gagtgaggg

SEQ ID NO: 4475 - DNA, 9 bp, Artificial Sequence
  Synthetic oligonucleotide
gagtgaggg

SEQ ID NO: 4476 - DNA, 9 bp, Artificial Sequence
  Synthetic oligonucleotide
gagtgaggt

SEQ ID NO: 4477 - DNA, 9 bp, Artificial Sequence
  Synthetic oligonucleotide
gagtgaggt

SEQ ID NO: 4478 - DNA, 9 bp, Artificial Sequence
  Synthetic oligonucleotide
gagtgaggt

SEQ ID NO: 4479 - DNA, 9 bp, Artificial Sequence
  Synthetic oligonucleotide
gagtgaggc

SEQ ID NO: 4480 - DNA, 9 bp, Artificial Sequence
  Synthetic oligonucleotide
gagtgaggc

SEQ ID NO: 4481 - DNA, 9 bp, Artificial Sequence
  Synthetic oligonucleotide
gagtgaggt

SEQ ID NO: 4482 - DNA, 9 bp, Artificial Sequence
  Synthetic oligonucleotide
gagtgaggg

SEQ ID NO: 4483 - DNA, 9 bp, Artificial Sequence
  Synthetic oligonucleotide
gagtgaggc

SEQ ID NO: 4484 - DNA, 9 bp, Artificial Sequence
  Synthetic oligonucleotide
gagtgaggg

SEQ ID NO: 4485 - DNA, 9 bp, Artificial Sequence
  Synthetic oligonucleotide
gagtgaggt

SEQ ID NO: 4486 - DNA, 9 bp, Artificial Sequence
  Synthetic oligonucleotide
gagggagga

SEQ ID NO: 4487 - DNA, 9 bp, Artificial Sequence
  Synthetic oligonucleotide
gagtgaggt

SEQ ID NO: 4488 - DNA, 9 bp, Artificial Sequence
  Synthetic oligonucleotide
gagtgaggg

SEQ ID NO: 4489 - DNA, 9 bp, Artificial Sequence
  Synthetic oligonucleotide
gagtgaggc

SEQ ID NO: 4490 - DNA, 9 bp, Artificial Sequence
  Synthetic oligonucleotide
gagtgaggt

SEQ ID NO: 4491 - DNA, 9 bp, Artificial Sequence
  Synthetic oligonucleotide
gagtgaggt

SEQ ID NO: 4492 - DNA, 9 bp, Artificial Sequence
  Synthetic oligonucleotide
gagtgaggg

SEQ ID NO: 4493 - DNA, 9 bp, Artificial Sequence
  Synthetic oligonucleotide
gagtgaggg

SEQ ID NO: 4494 - DNA, 9 bp, Artificial Sequence
  Synthetic oligonucleotide
gagtgaggg

SEQ ID NO: 4495 - DNA, 9 bp, Artificial Sequence
  Synthetic oligonucleotide
gagtgaggt

SEQ ID NO: 4496 - DNA, 9 bp, Artificial Sequence
  Synthetic oligonucleotide
gagtgaggg

SEQ ID NO: 4497 - DNA, 9 bp, Artificial Sequence
  Synthetic oligonucleotide
gagtgaggc

SEQ ID NO: 4498 - DNA, 9 bp, Artificial Sequence
  Synthetic oligonucleotide
aagtgagga

SEQ ID NO: 4499 - DNA, 9 bp, Artificial Sequence
  Synthetic oligonucleotide
gagtgaggg

SEQ ID NO: 4500 - DNA, 9 bp, Artificial Sequence
  Synthetic oligonucleotide
gagtgaggg

SEQ ID NO: 4501 - DNA, 9 bp, Artificial Sequence
  Synthetic oligonucleotide
gagtgaggg

SEQ ID NO: 4502 - DNA, 9 bp, Artificial Sequence
  Synthetic oligonucleotide
gagtgaggg

SEQ ID NO: 4503 - DNA, 9 bp, Artificial Sequence
  Synthetic oligonucleotide
gagtgaggg

SEQ ID NO: 4504 - DNA, 9 bp, Artificial Sequence
  Synthetic oligonucleotide
gagtgaggg

SEQ ID NO: 4505 - DNA, 9 bp, Artificial Sequence
  Synthetic oligonucleotide
gagtgaggc

SEQ ID NO: 4506 - DNA, 9 bp, Artificial Sequence
  Synthetic oligonucleotide
gagtgaggc

SEQ ID NO: 4507 - DNA, 9 bp, Artificial Sequence
  Synthetic oligonucleotide
gagtgaggg

SEQ ID NO: 4508 - DNA, 9 bp, Artificial Sequence
  Synthetic oligonucleotide
gagtgaggc

SEQ ID NO: 4509 - DNA, 9 bp, Artificial Sequence
  Synthetic oligonucleotide
gagtgaggt

SEQ ID NO: 4510 - DNA, 9 bp, Artificial Sequence
  Synthetic oligonucleotide
gagtgaggg

SEQ ID NO: 4511 - DNA, 9 bp, Artificial Sequence
  Synthetic oligonucleotide
gagtgagca

SEQ ID NO: 4512 - DNA, 9 bp, Artificial Sequence
  Synthetic oligonucleotide
gagtgaggt

SEQ ID NO: 4513 - DNA, 9 bp, Artificial Sequence
  Synthetic oligonucleotide
gagtgaggg

SEQ ID NO: 4514 - DNA, 9 bp, Artificial Sequence
  Synthetic oligonucleotide
gagtgaggg

SEQ ID NO: 4515 - DNA, 9 bp, Artificial Sequence
  Synthetic oligonucleotide
gagtgaggc

SEQ ID NO: 4516 - DNA, 9 bp, Artificial Sequence
  Synthetic oligonucleotide
gagtgaggg

SEQ ID NO: 4517 - DNA, 9 bp, Artificial Sequence
  Synthetic oligonucleotide
gagtgaggt

SEQ ID NO: 4518 - DNA, 9 bp, Artificial Sequence
  Synthetic oligonucleotide
gagtgaggc

SEQ ID NO: 4519 - DNA, 9 bp, Artificial Sequence
  Synthetic oligonucleotide
gagtgaggc

SEQ ID NO: 4520 - DNA, 9 bp, Artificial Sequence
  Synthetic oligonucleotide
gagtgaggg

SEQ ID NO: 4521 - DNA, 9 bp, Artificial Sequence
  Synthetic oligonucleotide
gagtgaggc

SEQ ID NO: 4522 - DNA, 9 bp, Artificial Sequence
  Synthetic oligonucleotide
gagtgagga

SEQ ID NO: 4523 - DNA, 9 bp, Artificial Sequence
  Synthetic oligonucleotide
gagtgagga

SEQ ID NO: 4524 - DNA, 9 bp, Artificial Sequence
  Synthetic oligonucleotide
gagtgagga

SEQ ID NO: 4525 - DNA, 9 bp, Artificial Sequence
  Synthetic oligonucleotide
gagtgagga

SEQ ID NO: 4526 - DNA, 9 bp, Artificial Sequence
  Synthetic oligonucleotide
gagtgagga

SEQ ID NO: 4527 - DNA, 9 bp, Artificial Sequence
  Synthetic oligonucleotide
gagtgagga

SEQ ID NO: 4528 - DNA, 9 bp, Artificial Sequence
  Synthetic oligonucleotide
gagtgagga

SEQ ID NO: 4529 - DNA, 9 bp, Artificial Sequence
  Synthetic oligonucleotide
gagtgaagt

SEQ ID NO: 4530 - DNA, 9 bp, Artificial Sequence
  Synthetic oligonucleotide
gagagaggc

SEQ ID NO: 4531 - DNA, 9 bp, Artificial Sequence
  Synthetic oligonucleotide
gagtgaagt

SEQ ID NO: 4532 - DNA, 9 bp, Artificial Sequence
  Synthetic oligonucleotide
gagtgagtt

SEQ ID NO: 4533 - DNA, 9 bp, Artificial Sequence
  Synthetic oligonucleotide
gagtgaggg

SEQ ID NO: 4534 - DNA, 9 bp, Artificial Sequence
  Synthetic oligonucleotide
gagtgaggg

SEQ ID NO: 4535 - DNA, 9 bp, Artificial Sequence
  Synthetic oligonucleotide
atgtgagga

SEQ ID NO: 4536 - DNA, 9 bp, Artificial Sequence
  Synthetic oligonucleotide
gagtgagga

SEQ ID NO: 4537 - DNA, 9 bp, Artificial Sequence
  Synthetic oligonucleotide
gagtgagtc

SEQ ID NO: 4538 - DNA, 9 bp, Artificial Sequence
  Synthetic oligonucleotide
gagagagga

SEQ ID NO: 4539 - DNA, 9 bp, Artificial Sequence
  Synthetic oligonucleotide
gagagagga

SEQ ID NO: 4540 - DNA, 9 bp, Artificial Sequence
  Synthetic oligonucleotide
gagagagga

SEQ ID NO: 4541 - DNA, 9 bp, Artificial Sequence
  Synthetic oligonucleotide
gagagagga

SEQ ID NO: 4542 - DNA, 9 bp, Artificial Sequence
  Synthetic oligonucleotide
gggtgagga

SEQ ID NO: 4543 - DNA, 9 bp, Artificial Sequence
  Synthetic oligonucleotide
gagggagga

SEQ ID NO: 4544 - DNA, 9 bp, Artificial Sequence
  Synthetic oligonucleotide
gagtgatga

SEQ ID NO: 4545 - DNA, 9 bp, Artificial Sequence
  Synthetic oligonucleotide
gagtgacga

SEQ ID NO: 4546 - DNA, 9 bp, Artificial Sequence
  Synthetic oligonucleotide
gcgtgagga

SEQ ID NO: 4547 - DNA, 9 bp, Artificial Sequence
  Synthetic oligonucleotide
gagtcagga

SEQ ID NO: 4548 - DNA, 9 bp, Artificial Sequence
  Synthetic oligonucleotide
gaatgagga

SEQ ID NO: 4549 - DNA, 9 bp, Artificial Sequence
  Synthetic oligonucleotide
gactgagga

SEQ ID NO: 4550 - DNA, 9 bp, Artificial Sequence
  Synthetic oligonucleotide
gagagagga

SEQ ID NO: 4551 - DNA, 9 bp, Artificial Sequence
  Synthetic oligonucleotide
gagagagga

SEQ ID NO: 4552 - DNA, 9 bp, Artificial Sequence
  Synthetic oligonucleotide
gcgtgagga

SEQ ID NO: 4553 - DNA, 9 bp, Artificial Sequence
  Synthetic oligonucleotide
gggtgagga

SEQ ID NO: 4554 - DNA, 9 bp, Artificial Sequence
  Synthetic oligonucleotide
gaatgagga

SEQ ID NO: 4555 - DNA, 9 bp, Artificial Sequence
  Synthetic oligonucleotide
gagtgagga

SEQ ID NO: 4556 - DNA, 9 bp, Artificial Sequence
  Synthetic oligonucleotide
gagtgagga

SEQ ID NO: 4557 - DNA, 9 bp, Artificial Sequence
  Synthetic oligonucleotide
gagtgagga

SEQ ID NO: 4558 - DNA, 9 bp, Artificial Sequence
  Synthetic oligonucleotide
gagtgagga

SEQ ID NO: 4559 - DNA, 9 bp, Artificial Sequence
  Synthetic oligonucleotide
gagtgagga

SEQ ID NO: 4560 - DNA, 9 bp, Artificial Sequence
  Synthetic oligonucleotide
gagtgagga

SEQ ID NO: 4561 - DNA, 9 bp, Artificial Sequence
  Synthetic oligonucleotide
gagtgagga

SEQ ID NO: 4562 - DNA, 9 bp, Artificial Sequence
  Synthetic oligonucleotide
gagtgagga

SEQ ID NO: 4563 - DNA, 9 bp, Artificial Sequence
  Synthetic oligonucleotide
gagtgagga

SEQ ID NO: 4564 - DNA, 9 bp, Artificial Sequence
  Synthetic oligonucleotide
gagtgagga

SEQ ID NO: 4565 - DNA, 9 bp, Artificial Sequence
  Synthetic oligonucleotide
gagtgagga

SEQ ID NO: 4566 - DNA, 9 bp, Artificial Sequence
  Synthetic oligonucleotide
gagtgagga

SEQ ID NO: 4567 - DNA, 9 bp, Artificial Sequence
  Synthetic oligonucleotide
gagtgagga

SEQ ID NO: 4568 - DNA, 9 bp, Artificial Sequence
  Synthetic oligonucleotide
gagtgagga

SEQ ID NO: 4569 - DNA, 9 bp, Artificial Sequence
  Synthetic oligonucleotide
gagtgagga

SEQ ID NO: 4570 - DNA, 9 bp, Artificial Sequence
  Synthetic oligonucleotide
gagtgagga

SEQ ID NO: 4571 - DNA, 9 bp, Artificial Sequence
  Synthetic oligonucleotide
gagtgagga

SEQ ID NO: 4572 - DNA, 9 bp, Artificial Sequence
  Synthetic oligonucleotide
gagtgagga

SEQ ID NO: 4573 - DNA, 9 bp, Artificial Sequence
  Synthetic oligonucleotide
gagtgagga

SEQ ID NO: 4574 - DNA, 9 bp, Artificial Sequence
  Synthetic oligonucleotide
gagtgagga

SEQ ID NO: 4575 - DNA, 9 bp, Artificial Sequence
  Synthetic oligonucleotide
gagtgagga

SEQ ID NO: 4576 - DNA, 9 bp, Artificial Sequence
  Synthetic oligonucleotide
gagtgagga

SEQ ID NO: 4577 - DNA, 9 bp, Artificial Sequence
  Synthetic oligonucleotide
gagtgagga

SEQ ID NO: 4578 - DNA, 9 bp, Artificial Sequence
  Synthetic oligonucleotide
gagtgagga

SEQ ID NO: 4579 - DNA, 9 bp, Artificial Sequence
  Synthetic oligonucleotide
gagtgagga

SEQ ID NO: 4580 - DNA, 9 bp, Artificial Sequence
  Synthetic oligonucleotide
gagtgagga

SEQ ID NO: 4581 - DNA, 9 bp, Artificial Sequence
  Synthetic oligonucleotide
gagtgagga

SEQ ID NO: 4582 - DNA, 9 bp, Artificial Sequence
  Synthetic oligonucleotide
gagtgagga

SEQ ID NO: 4583 - DNA, 9 bp, Artificial Sequence
  Synthetic oligonucleotide
gagtgagga

SEQ ID NO: 4584 - DNA, 9 bp, Artificial Sequence
  Synthetic oligonucleotide
gagtgagga

SEQ ID NO: 4585 - DNA, 9 bp, Artificial Sequence
  Synthetic oligonucleotide
gagtgagga

SEQ ID NO: 4586 - DNA, 9 bp, Artificial Sequence
  Synthetic oligonucleotide
gagtgagga

SEQ ID NO: 4587 - DNA, 9 bp, Artificial Sequence
  Synthetic oligonucleotide
gagtgagga

SEQ ID NO: 4588 - DNA, 9 bp, Artificial Sequence
  Synthetic oligonucleotide
gagtgagga

SEQ ID NO: 4589 - DNA, 9 bp, Artificial Sequence
  Synthetic oligonucleotide
gagtgagga

SEQ ID NO: 4590 - DNA, 9 bp, Artificial Sequence
  Synthetic oligonucleotide
gagtgagga

SEQ ID NO: 4591 - DNA, 9 bp, Artificial Sequence
  Synthetic oligonucleotide
gagtgagga

SEQ ID NO: 4592 - DNA, 9 bp, Artificial Sequence
  Synthetic oligonucleotide
aaattagga

SEQ ID NO: 4593 - DNA, 9 bp, Artificial Sequence
  Synthetic oligonucleotide
gaccgaggt

SEQ ID NO: 4594 - DNA, 9 bp, Artificial Sequence
  Synthetic oligonucleotide
gcgtggcga

SEQ ID NO: 4595 - DNA, 9 bp, Artificial Sequence
  Synthetic oligonucleotide
ggtggagga

SEQ ID NO: 4596 - DNA, 9 bp, Artificial Sequence
  Synthetic oligonucleotide
gagtcagcc

SEQ ID NO: 4597 - DNA, 9 bp, Artificial Sequence
  Synthetic oligonucleotide
aagtcaggt

SEQ ID NO: 4598 - DNA, 9 bp, Artificial Sequence
  Synthetic oligonucleotide
gcctgatga

SEQ ID NO: 4599 - DNA, 9 bp, Artificial Sequence
  Synthetic oligonucleotide
gacagagaa

SEQ ID NO: 4600 - DNA, 9 bp, Artificial Sequence
  Synthetic oligonucleotide
gtttgggga

SEQ ID NO: 4601 - DNA, 9 bp, Artificial Sequence
  Synthetic oligonucleotide
gagacagca

SEQ ID NO: 4602 - DNA, 9 bp, Artificial Sequence
  Synthetic oligonucleotide
gagctggga

SEQ ID NO: 4603 - DNA, 9 bp, Artificial Sequence
  Synthetic oligonucleotide
gcggcagga

SEQ ID NO: 4604 - DNA, 9 bp, Artificial Sequence
  Synthetic oligonucleotide
gcggcagga

SEQ ID NO: 4605 - DNA, 9 bp, Artificial Sequence
  Synthetic oligonucleotide
aagcgagta

SEQ ID NO: 4606 - DNA, 9 bp, Artificial Sequence
  Synthetic oligonucleotide
cagagagca

SEQ ID NO: 4607 - DNA, 9 bp, Artificial Sequence
  Synthetic oligonucleotide
ggctgggga

SEQ ID NO: 4608 - DNA, 9 bp, Artificial Sequence
  Synthetic oligonucleotide
ggctgggga

SEQ ID NO: 4609 - DNA, 9 bp, Artificial Sequence
  Synthetic oligonucleotide
gagtcatgt

SEQ ID NO: 4610 - DNA, 9 bp, Artificial Sequence
  Synthetic oligonucleotide
gcgggggga

SEQ ID NO: 4611 - DNA, 9 bp, Artificial Sequence
  Synthetic oligonucleotide
aattgggga

SEQ ID NO: 4612 - DNA, 9 bp, Artificial Sequence
  Synthetic oligonucleotide
gagtcagcc

SEQ ID NO: 4613 - DNA, 9 bp, Artificial Sequence
  Synthetic oligonucleotide
gcgggagga

SEQ ID NO: 4614 - DNA, 9 bp, Artificial Sequence
  Synthetic oligonucleotide
gggtgaggc

SEQ ID NO: 4615 - DNA, 9 bp, Artificial Sequence
  Synthetic oligonucleotide
gagtgaaca

SEQ ID NO: 4616 - DNA, 9 bp, Artificial Sequence
  Synthetic oligonucleotide
gagtgaagc

SEQ ID NO: 4617 - DNA, 9 bp, Artificial Sequence
  Synthetic oligonucleotide
gagtgtgca

SEQ ID NO: 4618 - DNA, 9 bp, Artificial Sequence
  Synthetic oligonucleotide
tagtgagca

SEQ ID NO: 4619 - DNA, 9 bp, Artificial Sequence
  Synthetic oligonucleotide
tagtaagga

SEQ ID NO: 4620 - DNA, 9 bp, Artificial Sequence
  Synthetic oligonucleotide
aagtgagaa

SEQ ID NO: 4621 - DNA, 9 bp, Artificial Sequence
  Synthetic oligonucleotide
gagtgtggg

SEQ ID NO: 4622 - DNA, 9 bp, Artificial Sequence
  Synthetic oligonucleotide
cagtgagaa

SEQ ID NO: 4623 - DNA, 9 bp, Artificial Sequence
  Synthetic oligonucleotide
gggtgaggc

SEQ ID NO: 4624 - DNA, 9 bp, Artificial Sequence
  Synthetic oligonucleotide
gggtgaggc

SEQ ID NO: 4625 - DNA, 9 bp, Artificial Sequence
  Synthetic oligonucleotide
gagtgtggt

SEQ ID NO: 4626 - DNA, 9 bp, Artificial Sequence
  Synthetic oligonucleotide
gagggaggg

SEQ ID NO: 4627 - DNA, 9 bp, Artificial Sequence
  Synthetic oligonucleotide
gtgtgagaa

SEQ ID NO: 4628 - DNA, 9 bp, Artificial Sequence
  Synthetic oligonucleotide
aggtgagga

SEQ ID NO: 4629 - DNA, 9 bp, Artificial Sequence
  Synthetic oligonucleotide
cagtgatga

SEQ ID NO: 4630 - DNA, 9 bp, Artificial Sequence
  Synthetic oligonucleotide
gagggaggg

SEQ ID NO: 4631 - DNA, 9 bp, Artificial Sequence
  Synthetic oligonucleotide
tggtgagga

SEQ ID NO: 4632 - DNA, 9 bp, Artificial Sequence
  Synthetic oligonucleotide
aagtgaaga

SEQ ID NO: 4633 - DNA, 9 bp, Artificial Sequence
  Synthetic oligonucleotide
gagtgaagg

SEQ ID NO: 4634 - DNA, 9 bp, Artificial Sequence
  Synthetic oligonucleotide
gggtaagga

SEQ ID NO: 4635 - DNA, 9 bp, Artificial Sequence
  Synthetic oligonucleotide
gagtggggc

SEQ ID NO: 4636 - DNA, 9 bp, Artificial Sequence
  Synthetic oligonucleotide
gagtgataa

SEQ ID NO: 4637 - DNA, 9 bp, Artificial Sequence
  Synthetic oligonucleotide
gggtaagga

SEQ ID NO: 4638 - DNA, 9 bp, Artificial Sequence
  Synthetic oligonucleotide
gggtaagga

SEQ ID NO: 4639 - DNA, 9 bp, Artificial Sequence
  Synthetic oligonucleotide
gggtaagga

SEQ ID NO: 4640 - DNA, 9 bp, Artificial Sequence
  Synthetic oligonucleotide
gggtaagga

SEQ ID NO: 4641 - DNA, 9 bp, Artificial Sequence
  Synthetic oligonucleotide
gaatgaggc

SEQ ID NO: 4642 - DNA, 9 bp, Artificial Sequence
  Synthetic oligonucleotide
gagggagaa

SEQ ID NO: 4643 - DNA, 9 bp, Artificial Sequence
  Synthetic oligonucleotide
gagtgtgaa

SEQ ID NO: 4644 - DNA, 9 bp, Artificial Sequence
  Synthetic oligonucleotide
gattgaaga

SEQ ID NO: 4645 - DNA, 9 bp, Artificial Sequence
  Synthetic oligonucleotide
gagggagaa

SEQ ID NO: 4646 - DNA, 9 bp, Artificial Sequence
  Synthetic oligonucleotide
gagagaggc

SEQ ID NO: 4647 - DNA, 9 bp, Artificial Sequence
  Synthetic oligonucleotide
gaaggagga

SEQ ID NO: 4648 - DNA, 9 bp, Artificial Sequence
  Synthetic oligonucleotide
gagagaggg

SEQ ID NO: 4649 - DNA, 9 bp, Artificial Sequence
  Synthetic oligonucleotide
gagtgggta

SEQ ID NO: 4650 - DNA, 9 bp, Artificial Sequence
  Synthetic oligonucleotide
aaatgagga

SEQ ID NO: 4651 - DNA, 9 bp, Artificial Sequence
  Synthetic oligonucleotide
tggtgagga

SEQ ID NO: 4652 - DNA, 9 bp, Artificial Sequence
  Synthetic oligonucleotide
gaggaagga

SEQ ID NO: 4653 - DNA, 9 bp, Artificial Sequence
  Synthetic oligonucleotide
gactgaaga

SEQ ID NO: 4654 - DNA, 9 bp, Artificial Sequence
  Synthetic oligonucleotide
ttgtgagga

SEQ ID NO: 4655 - DNA, 9 bp, Artificial Sequence
  Synthetic oligonucleotide
cagtgatga

SEQ ID NO: 4656 - DNA, 9 bp, Artificial Sequence
  Synthetic oligonucleotide
aagggagga

SEQ ID NO: 4657 - DNA, 9 bp, Artificial Sequence
  Synthetic oligonucleotide
gagtcagta

SEQ ID NO: 4658 - DNA, 9 bp, Artificial Sequence
  Synthetic oligonucleotide
gagtaaggg

SEQ ID NO: 4659 - DNA, 9 bp, Artificial Sequence
  Synthetic oligonucleotide
gtgtgagaa

SEQ ID NO: 4660 - DNA, 9 bp, Artificial Sequence
  Synthetic oligonucleotide
gagtgcggc

SEQ ID NO: 4661 - DNA, 9 bp, Artificial Sequence
  Synthetic oligonucleotide
cagtgagaa

SEQ ID NO: 4662 - DNA, 9 bp, Artificial Sequence
  Synthetic oligonucleotide
gagtgaaca

SEQ ID NO: 4663 - DNA, 9 bp, Artificial Sequence
  Synthetic oligonucleotide
aactgagga

SEQ ID NO: 4664 - DNA, 9 bp, Artificial Sequence
  Synthetic oligonucleotide
gagggaggg

SEQ ID NO: 4665 - DNA, 9 bp, Artificial Sequence
  Synthetic oligonucleotide
gagtgggaa

SEQ ID NO: 4666 - DNA, 9 bp, Artificial Sequence
  Synthetic oligonucleotide
aagtgaggg

SEQ ID NO: 4667 - DNA, 9 bp, Artificial Sequence
  Synthetic oligonucleotide
gagtgagct

SEQ ID NO: 4668 - DNA, 9 bp, Artificial Sequence
  Synthetic oligonucleotide
gagtggggc

SEQ ID NO: 4669 - DNA, 9 bp, Artificial Sequence
  Synthetic oligonucleotide
gagacagga

SEQ ID NO: 4670 - DNA, 9 bp, Artificial Sequence
  Synthetic oligonucleotide
gaatgggga

SEQ ID NO: 4671 - DNA, 9 bp, Artificial Sequence
  Synthetic oligonucleotide
gggtgaggc

SEQ ID NO: 4672 - DNA, 9 bp, Artificial Sequence
  Synthetic oligonucleotide
gagggaggt

SEQ ID NO: 4673 - DNA, 9 bp, Artificial Sequence
  Synthetic oligonucleotide
gggcgagga

SEQ ID NO: 4674 - DNA, 9 bp, Artificial Sequence
  Synthetic oligonucleotide
gagggaaga

SEQ ID NO: 4675 - DNA, 9 bp, Artificial Sequence
  Synthetic oligonucleotide
gagggagca

SEQ ID NO: 4676 - DNA, 9 bp, Artificial Sequence
  Synthetic oligonucleotide
gaggcagga

SEQ ID NO: 4677 - DNA, 9 bp, Artificial Sequence
  Synthetic oligonucleotide
gagggagaa

SEQ ID NO: 4678 - DNA, 9 bp, Artificial Sequence
  Synthetic oligonucleotide
tggtgagga

SEQ ID NO: 4679 - DNA, 9 bp, Artificial Sequence
  Synthetic oligonucleotide
aagagagga

SEQ ID NO: 4680 - DNA, 9 bp, Artificial Sequence
  Synthetic oligonucleotide
gagtggaga

SEQ ID NO: 4681 - DNA, 9 bp, Artificial Sequence
  Synthetic oligonucleotide
gagggaggt

SEQ ID NO: 4682 - DNA, 9 bp, Artificial Sequence
  Synthetic oligonucleotide
aagtgaggg

SEQ ID NO: 4683 - DNA, 9 bp, Artificial Sequence
  Synthetic oligonucleotide
gagtaagca

SEQ ID NO: 4684 - DNA, 9 bp, Artificial Sequence
  Synthetic oligonucleotide
tagtgatga

SEQ ID NO: 4685 - DNA, 9 bp, Artificial Sequence
  Synthetic oligonucleotide
gagaaagga

SEQ ID NO: 4686 - DNA, 9 bp, Artificial Sequence
  Synthetic oligonucleotide
gagtgcaga

SEQ ID NO: 4687 - DNA, 9 bp, Artificial Sequence
  Synthetic oligonucleotide
gaggaagga

SEQ ID NO: 4688 - DNA, 9 bp, Artificial Sequence
  Synthetic oligonucleotide
gaatgagaa

SEQ ID NO: 4689 - DNA, 9 bp, Artificial Sequence
  Synthetic oligonucleotide
gagggaggt

SEQ ID NO: 4690 - DNA, 9 bp, Artificial Sequence
  Synthetic oligonucleotide
gtgtgaggg

SEQ ID NO: 4691 - DNA, 9 bp, Artificial Sequence
  Synthetic oligonucleotide
aagtgagaa

SEQ ID NO: 4692 - DNA, 9 bp, Artificial Sequence
  Synthetic oligonucleotide
gactgaggt

SEQ ID NO: 4693 - DNA, 9 bp, Artificial Sequence
  Synthetic oligonucleotide
gtgtcagga

SEQ ID NO: 4694 - DNA, 9 bp, Artificial Sequence
  Synthetic oligonucleotide
gagtgtgaa

SEQ ID NO: 4695 - DNA, 9 bp, Artificial Sequence
  Synthetic oligonucleotide
gagtgagtg

SEQ ID NO: 4696 - DNA, 9 bp, Artificial Sequence
  Synthetic oligonucleotide
gagttaaga

SEQ ID NO: 4697 - DNA, 9 bp, Artificial Sequence
  Synthetic oligonucleotide
gagcgagca

SEQ ID NO: 4698 - DNA, 9 bp, Artificial Sequence
  Synthetic oligonucleotide
gagacagga

SEQ ID NO: 4699 - DNA, 9 bp, Artificial Sequence
  Synthetic oligonucleotide
cagttagga

SEQ ID NO: 4700 - DNA, 9 bp, Artificial Sequence
  Synthetic oligonucleotide
gagtgaagc

SEQ ID NO: 4701 - DNA, 9 bp, Artificial Sequence
  Synthetic oligonucleotide
tggtgagga

SEQ ID NO: 4702 - DNA, 9 bp, Artificial Sequence
  Synthetic oligonucleotide
gaggcagga

SEQ ID NO: 4703 - DNA, 9 bp, Artificial Sequence
  Synthetic oligonucleotide
aggtgagga

SEQ ID NO: 4704 - DNA, 9 bp, Artificial Sequence
  Synthetic oligonucleotide
gagtcagca

SEQ ID NO: 4705 - DNA, 9 bp, Artificial Sequence
  Synthetic oligonucleotide
gagggagaa

SEQ ID NO: 4706 - DNA, 9 bp, Artificial Sequence
  Synthetic oligonucleotide
gtgagagga

SEQ ID NO: 4707 - DNA, 9 bp, Artificial Sequence
  Synthetic oligonucleotide
gagtgggta

SEQ ID NO: 4708 - DNA, 9 bp, Artificial Sequence
  Synthetic oligonucleotide
cagtgagaa

SEQ ID NO: 4709 - DNA, 9 bp, Artificial Sequence
  Synthetic oligonucleotide
gagtgggta

SEQ ID NO: 4710 - DNA, 9 bp, Artificial Sequence
  Synthetic oligonucleotide
gactgaggt

SEQ ID NO: 4711 - DNA, 9 bp, Artificial Sequence
  Synthetic oligonucleotide
gggggagga

SEQ ID NO: 4712 - DNA, 9 bp, Artificial Sequence
  Synthetic oligonucleotide
gagagaggg

SEQ ID NO: 4713 - DNA, 9 bp, Artificial Sequence
  Synthetic oligonucleotide
aagtgagca

SEQ ID NO: 4714 - DNA, 9 bp, Artificial Sequence
  Synthetic oligonucleotide
gagtgagac

SEQ ID NO: 4715 - DNA, 9 bp, Artificial Sequence
  Synthetic oligonucleotide
gagagtgga

SEQ ID NO: 4716 - DNA, 9 bp, Artificial Sequence
  Synthetic oligonucleotide
aagtgcgga

SEQ ID NO: 4717 - DNA, 9 bp, Artificial Sequence
  Synthetic oligonucleotide
aagtgagaa

SEQ ID NO: 4718 - DNA, 9 bp, Artificial Sequence
  Synthetic oligonucleotide
gagtgaagg

SEQ ID NO: 4719 - DNA, 9 bp, Artificial Sequence
  Synthetic oligonucleotide
cagcgagga

SEQ ID NO: 4720 - DNA, 9 bp, Artificial Sequence
  Synthetic oligonucleotide
tggtgagga

SEQ ID NO: 4721 - DNA, 9 bp, Artificial Sequence
  Synthetic oligonucleotide
gagtgtggt

SEQ ID NO: 4722 - DNA, 9 bp, Artificial Sequence
  Synthetic oligonucleotide
aggtgagga

SEQ ID NO: 4723 - DNA, 9 bp, Artificial Sequence
  Synthetic oligonucleotide
gaatgaggc

SEQ ID NO: 4724 - DNA, 9 bp, Artificial Sequence
  Synthetic oligonucleotide
gaatgagta

SEQ ID NO: 4725 - DNA, 9 bp, Artificial Sequence
  Synthetic oligonucleotide
gagggagaa

SEQ ID NO: 4726 - DNA, 9 bp, Artificial Sequence
  Synthetic oligonucleotide
gagtgcggc

SEQ ID NO: 4727 - DNA, 9 bp, Artificial Sequence
  Synthetic oligonucleotide
gagggaggg

SEQ ID NO: 4728 - DNA, 9 bp, Artificial Sequence
  Synthetic oligonucleotide
gagggaggg

SEQ ID NO: 4729 - DNA, 9 bp, Artificial Sequence
  Synthetic oligonucleotide
tagtgaaga

SEQ ID NO: 4730 - DNA, 9 bp, Artificial Sequence
  Synthetic oligonucleotide
gagagtgga

SEQ ID NO: 4731 - DNA, 9 bp, Artificial Sequence
  Synthetic oligonucleotide
gagggaggg

SEQ ID NO: 4732 - DNA, 9 bp, Artificial Sequence
  Synthetic oligonucleotide
gggtgaggt

SEQ ID NO: 4733 - DNA, 9 bp, Artificial Sequence
  Synthetic oligonucleotide
cagtgaggc

SEQ ID NO: 4734 - DNA, 9 bp, Artificial Sequence
  Synthetic oligonucleotide
gaatgaggg

SEQ ID NO: 4735 - DNA, 9 bp, Artificial Sequence
  Synthetic oligonucleotide
gagtggggg

SEQ ID NO: 4736 - DNA, 9 bp, Artificial Sequence
  Synthetic oligonucleotide
gagtggggc

SEQ ID NO: 4737 - DNA, 9 bp, Artificial Sequence
  Synthetic oligonucleotide
gagaaagga

SEQ ID NO: 4738 - DNA, 9 bp, Artificial Sequence
  Synthetic oligonucleotide
gagggaggg

SEQ ID NO: 4739 - DNA, 9 bp, Artificial Sequence
  Synthetic oligonucleotide
gagagagaa

SEQ ID NO: 4740 - DNA, 9 bp, Artificial Sequence
  Synthetic oligonucleotide
gagtgaaaa

SEQ ID NO: 4741 - DNA, 9 bp, Artificial Sequence
  Synthetic oligonucleotide
gagtaagaa

SEQ ID NO: 4742 - DNA, 9 bp, Artificial Sequence
  Synthetic oligonucleotide
aagtgagca

SEQ ID NO: 4743 - DNA, 9 bp, Artificial Sequence
  Synthetic oligonucleotide
tggtgagga

SEQ ID NO: 4744 - DNA, 9 bp, Artificial Sequence
  Synthetic oligonucleotide
ctgtgagga

SEQ ID NO: 4745 - DNA, 9 bp, Artificial Sequence
  Synthetic oligonucleotide
gagtggggc

SEQ ID NO: 4746 - DNA, 9 bp, Artificial Sequence
  Synthetic oligonucleotide
gagtgaaaa

SEQ ID NO: 4747 - DNA, 9 bp, Artificial Sequence
  Synthetic oligonucleotide
gagggaaga

SEQ ID NO: 4748 - DNA, 9 bp, Artificial Sequence
  Synthetic oligonucleotide
gagtgagtg

SEQ ID NO: 4749 - DNA, 9 bp, Artificial Sequence
  Synthetic oligonucleotide
aagtgtgga

SEQ ID NO: 4750 - DNA, 9 bp, Artificial Sequence
  Synthetic oligonucleotide
aagagagga

SEQ ID NO: 4751 - DNA, 9 bp, Artificial Sequence
  Synthetic oligonucleotide
aagagagga

SEQ ID NO: 4752 - DNA, 9 bp, Artificial Sequence
  Synthetic oligonucleotide
aagagagga

SEQ ID NO: 4753 - DNA, 9 bp, Artificial Sequence
  Synthetic oligonucleotide
gagagagga

SEQ ID NO: 4754 - DNA, 9 bp, Artificial Sequence
  Synthetic oligonucleotide
gagagagga

SEQ ID NO: 4755 - DNA, 9 bp, Artificial Sequence
  Synthetic oligonucleotide
tagtgagga

SEQ ID NO: 4756 - DNA, 9 bp, Artificial Sequence
  Synthetic oligonucleotide
gagtgagca

SEQ ID NO: 4757 - DNA, 9 bp, Artificial Sequence
  Synthetic oligonucleotide
tagtgagga

SEQ ID NO: 4758 - DNA, 9 bp, Artificial Sequence
  Synthetic oligonucleotide
gtgtgagga

SEQ ID NO: 4759 - DNA, 9 bp, Artificial Sequence
  Synthetic oligonucleotide
gagtgaggg

SEQ ID NO: 4760 - DNA, 9 bp, Artificial Sequence
  Synthetic oligonucleotide
gagagagga

SEQ ID NO: 4761 - DNA, 9 bp, Artificial Sequence
  Synthetic oligonucleotide
cagtgagga

SEQ ID NO: 4762 - DNA, 9 bp, Artificial Sequence
  Synthetic oligonucleotide
gagtgaaga

SEQ ID NO: 4763 - DNA, 9 bp, Artificial Sequence
  Synthetic oligonucleotide
gagtgtgga

SEQ ID NO: 4764 - DNA, 9 bp, Artificial Sequence
  Synthetic oligonucleotide
gagggagga

SEQ ID NO: 4765 - DNA, 9 bp, Artificial Sequence
  Synthetic oligonucleotide
gtgtgagga

SEQ ID NO: 4766 - DNA, 9 bp, Artificial Sequence
  Synthetic oligonucleotide
gagagagga

SEQ ID NO: 4767 - DNA, 9 bp, Artificial Sequence
  Synthetic oligonucleotide
gagtgagaa

SEQ ID NO: 4768 - DNA, 9 bp, Artificial Sequence
  Synthetic oligonucleotide
gagtgggga

SEQ ID NO: 4769 - DNA, 9 bp, Artificial Sequence
  Synthetic oligonucleotide
cagtgagga

SEQ ID NO: 4770 - DNA, 9 bp, Artificial Sequence
  Synthetic oligonucleotide
cagtgagga

SEQ ID NO: 4771 - DNA, 9 bp, Artificial Sequence
  Synthetic oligonucleotide
gagtgagta

SEQ ID NO: 4772 - DNA, 9 bp, Artificial Sequence
  Synthetic oligonucleotide
gggtgagga

SEQ ID NO: 4773 - DNA, 9 bp, Artificial Sequence
  Synthetic oligonucleotide
gagagagga

SEQ ID NO: 4774 - DNA, 9 bp, Artificial Sequence
  Synthetic oligonucleotide
gagtgaggg

SEQ ID NO: 4775 - DNA, 9 bp, Artificial Sequence
  Synthetic oligonucleotide
aagtgagga

SEQ ID NO: 4776 - DNA, 9 bp, Artificial Sequence
  Synthetic oligonucleotide
gagtcagga

SEQ ID NO: 4777 - DNA, 9 bp, Artificial Sequence
  Synthetic oligonucleotide
gagtgaggt

SEQ ID NO: 4778 - DNA, 9 bp, Artificial Sequence
  Synthetic oligonucleotide
gagtgtgga

SEQ ID NO: 4779 - DNA, 9 bp, Artificial Sequence
  Synthetic oligonucleotide
gagtgagta

SEQ ID NO: 4780 - DNA, 9 bp, Artificial Sequence
  Synthetic oligonucleotide
aagtgagga

SEQ ID NO: 4781 - DNA, 9 bp, Artificial Sequence
  Synthetic oligonucleotide
aagtgagga

SEQ ID NO: 4782 - DNA, 9 bp, Artificial Sequence
  Synthetic oligonucleotide
gagcgagga

SEQ ID NO: 4783 - DNA, 9 bp, Artificial Sequence
  Synthetic oligonucleotide
gagtgaggg

SEQ ID NO: 4784 - DNA, 9 bp, Artificial Sequence
  Synthetic oligonucleotide
gagggagga

SEQ ID NO: 4785 - DNA, 9 bp, Artificial Sequence
  Synthetic oligonucleotide
gagtgaggg

SEQ ID NO: 4786 - DNA, 9 bp, Artificial Sequence
  Synthetic oligonucleotide
gagtgaaga

SEQ ID NO: 4787 - DNA, 9 bp, Artificial Sequence
  Synthetic oligonucleotide
gagtgaggg

SEQ ID NO: 4788 - DNA, 9 bp, Artificial Sequence
  Synthetic oligonucleotide
gagtgaggg

SEQ ID NO: 4789 - DNA, 9 bp, Artificial Sequence
  Synthetic oligonucleotide
gagtgaggg

SEQ ID NO: 4790 - DNA, 9 bp, Artificial Sequence
  Synthetic oligonucleotide
gagtgaggg

SEQ ID NO: 4791 - DNA, 9 bp, Artificial Sequence
  Synthetic oligonucleotide
gagtgaggg

SEQ ID NO: 4792 - DNA, 9 bp, Artificial Sequence
  Synthetic oligonucleotide
gagtgaggg

SEQ ID NO: 4793 - DNA, 9 bp, Artificial Sequence
  Synthetic oligonucleotide
gagtgagaa

SEQ ID NO: 4794 - DNA, 9 bp, Artificial Sequence
  Synthetic oligonucleotide
gagcgagga

SEQ ID NO: 4795 - DNA, 9 bp, Artificial Sequence
  Synthetic oligonucleotide
tagtgagga

SEQ ID NO: 4796 - DNA, 9 bp, Artificial Sequence
  Synthetic oligonucleotide
aagtgagga

SEQ ID NO: 4797 - DNA, 9 bp, Artificial Sequence
  Synthetic oligonucleotide
aagtgagga

SEQ ID NO: 4798 - DNA, 9 bp, Artificial Sequence
  Synthetic oligonucleotide
gagggagga

SEQ ID NO: 4799 - DNA, 9 bp, Artificial Sequence
  Synthetic oligonucleotide
gagtgaggg

SEQ ID NO: 4800 - DNA, 9 bp, Artificial Sequence
  Synthetic oligonucleotide
gagagagga

SEQ ID NO: 4801 - DNA, 9 bp, Artificial Sequence
  Synthetic oligonucleotide
tagtgagga

SEQ ID NO: 4802 - DNA, 9 bp, Artificial Sequence
  Synthetic oligonucleotide
gagtaagga

SEQ ID NO: 4803 - DNA, 9 bp, Artificial Sequence
  Synthetic oligonucleotide
gagtgtgga

SEQ ID NO: 4804 - DNA, 9 bp, Artificial Sequence
  Synthetic oligonucleotide
gagggagga

SEQ ID NO: 4805 - DNA, 9 bp, Artificial Sequence
  Synthetic oligonucleotide
tagtgagga

SEQ ID NO: 4806 - DNA, 9 bp, Artificial Sequence
  Synthetic oligonucleotide
gagggagga

SEQ ID NO: 4807 - DNA, 9 bp, Artificial Sequence
  Synthetic oligonucleotide
gagtgaaga

SEQ ID NO: 4808 - DNA, 9 bp, Artificial Sequence
  Synthetic oligonucleotide
gagtgaggg

SEQ ID NO: 4809 - DNA, 9 bp, Artificial Sequence
  Synthetic oligonucleotide
gagtgaggg

SEQ ID NO: 4810 - DNA, 9 bp, Artificial Sequence
  Synthetic oligonucleotide
gtgtgagga

SEQ ID NO: 4811 - DNA, 9 bp, Artificial Sequence
  Synthetic oligonucleotide
gagtaagga

SEQ ID NO: 4812 - DNA, 9 bp, Artificial Sequence
  Synthetic oligonucleotide
gagtgaggg

SEQ ID NO: 4813 - DNA, 9 bp, Artificial Sequence
  Synthetic oligonucleotide
cagtgagga

SEQ ID NO: 4814 - DNA, 9 bp, Artificial Sequence
  Synthetic oligonucleotide
gggtgagga

SEQ ID NO: 4815 - DNA, 9 bp, Artificial Sequence
  Synthetic oligonucleotide
gagtgaggg

SEQ ID NO: 4816 - DNA, 9 bp, Artificial Sequence
  Synthetic oligonucleotide
gggtgagga

SEQ ID NO: 4817 - DNA, 9 bp, Artificial Sequence
  Synthetic oligonucleotide
gagtgagca

SEQ ID NO: 4818 - DNA, 9 bp, Artificial Sequence
  Synthetic oligonucleotide
gagagagga

SEQ ID NO: 4819 - DNA, 9 bp, Artificial Sequence
  Synthetic oligonucleotide
gaatgagga

SEQ ID NO: 4820 - DNA, 9 bp, Artificial Sequence
  Synthetic oligonucleotide
gagtgaggg

SEQ ID NO: 4821 - DNA, 9 bp, Artificial Sequence
  Synthetic oligonucleotide
aagtgagga

SEQ ID NO: 4822 - DNA, 9 bp, Artificial Sequence
  Synthetic oligonucleotide
cagtgagga

SEQ ID NO: 4823 - DNA, 9 bp, Artificial Sequence
  Synthetic oligonucleotide
gagttagga

SEQ ID NO: 4824 - DNA, 9 bp, Artificial Sequence
  Synthetic oligonucleotide
gaatgagga

SEQ ID NO: 4825 - DNA, 9 bp, Artificial Sequence
  Synthetic oligonucleotide
gagggagga

SEQ ID NO: 4826 - DNA, 9 bp, Artificial Sequence
  Synthetic oligonucleotide
gagtgaaga

SEQ ID NO: 4827 - DNA, 9 bp, Artificial Sequence
  Synthetic oligonucleotide
gagtcagga

SEQ ID NO: 4828 - DNA, 9 bp, Artificial Sequence
  Synthetic oligonucleotide
gagtgaggg

SEQ ID NO: 4829 - DNA, 9 bp, Artificial Sequence
  Synthetic oligonucleotide
gagtgagca

SEQ ID NO: 4830 - DNA, 9 bp, Artificial Sequence
  Synthetic oligonucleotide
aagtgagga

SEQ ID NO: 4831 - DNA, 9 bp, Artificial Sequence
  Synthetic oligonucleotide
gtgtgagga

SEQ ID NO: 4832 - DNA, 9 bp, Artificial Sequence
  Synthetic oligonucleotide
gagtgaggc

SEQ ID NO: 4833 - DNA, 9 bp, Artificial Sequence
  Synthetic oligonucleotide
cagtgagga

SEQ ID NO: 4834 - DNA, 9 bp, Artificial Sequence
  Synthetic oligonucleotide
aagtgagga

SEQ ID NO: 4835 - DNA, 9 bp, Artificial Sequence
  Synthetic oligonucleotide
aagtgagga

SEQ ID NO: 4836 - DNA, 9 bp, Artificial Sequence
  Synthetic oligonucleotide
gagggagga

SEQ ID NO: 4837 - DNA, 9 bp, Artificial Sequence
  Synthetic oligonucleotide
gagtgagaa

SEQ ID NO: 4838 - DNA, 9 bp, Artificial Sequence
  Synthetic oligonucleotide
gggtgagga

SEQ ID NO: 4839 - DNA, 9 bp, Artificial Sequence
  Synthetic oligonucleotide
gagtgacga

SEQ ID NO: 4840 - DNA, 9 bp, Artificial Sequence
  Synthetic oligonucleotide
aagtgagga

SEQ ID NO: 4841 - DNA, 9 bp, Artificial Sequence
  Synthetic oligonucleotide
gagagagga

SEQ ID NO: 4842 - DNA, 9 bp, Artificial Sequence
  Synthetic oligonucleotide
gagtgagaa

SEQ ID NO: 4843 - DNA, 9 bp, Artificial Sequence
  Synthetic oligonucleotide
tagtgagga

SEQ ID NO: 4844 - DNA, 9 bp, Artificial Sequence
  Synthetic oligonucleotide
gagtgagca

SEQ ID NO: 4845 - DNA, 9 bp, Artificial Sequence
  Synthetic oligonucleotide
aagtgagga

SEQ ID NO: 4846 - DNA, 9 bp, Artificial Sequence
  Synthetic oligonucleotide
tagtgagga

SEQ ID NO: 4847 - DNA, 9 bp, Artificial Sequence
  Synthetic oligonucleotide
gagtgaggg

SEQ ID NO: 4848 - DNA, 9 bp, Artificial Sequence
  Synthetic oligonucleotide
gggtgagga

SEQ ID NO: 4849 - DNA, 9 bp, Artificial Sequence
  Synthetic oligonucleotide
gggtgagga

SEQ ID NO: 4850 - DNA, 9 bp, Artificial Sequence
  Synthetic oligonucleotide
gagtgagta

SEQ ID NO: 4851 - DNA, 9 bp, Artificial Sequence
  Synthetic oligonucleotide
gtgtgagga

SEQ ID NO: 4852 - DNA, 9 bp, Artificial Sequence
  Synthetic oligonucleotide
aagtgagga

SEQ ID NO: 4853 - DNA, 9 bp, Artificial Sequence
  Synthetic oligonucleotide
gagggagga

SEQ ID NO: 4854 - DNA, 9 bp, Artificial Sequence
  Synthetic oligonucleotide
gagagagga

SEQ ID NO: 4855 - DNA, 9 bp, Artificial Sequence
  Synthetic oligonucleotide
gagtgagaa

SEQ ID NO: 4856 - DNA, 9 bp, Artificial Sequence
  Synthetic oligonucleotide
gggtgagga

SEQ ID NO: 4857 - DNA, 9 bp, Artificial Sequence
  Synthetic oligonucleotide
gagtgagca

SEQ ID NO: 4858 - DNA, 9 bp, Artificial Sequence
  Synthetic oligonucleotide
gggtgagga

SEQ ID NO: 4859 - DNA, 9 bp, Artificial Sequence
  Synthetic oligonucleotide
gagtgagca

SEQ ID NO: 4860 - DNA, 9 bp, Artificial Sequence
  Synthetic oligonucleotide
aagtgagga

SEQ ID NO: 4861 - DNA, 9 bp, Artificial Sequence
  Synthetic oligonucleotide
gagtgagta

SEQ ID NO: 4862 - DNA, 9 bp, Artificial Sequence
  Synthetic oligonucleotide
tagtgagga

SEQ ID NO: 4863 - DNA, 9 bp, Artificial Sequence
  Synthetic oligonucleotide
gagagagga

SEQ ID NO: 4864 - DNA, 9 bp, Artificial Sequence
  Synthetic oligonucleotide
cagtgagga

SEQ ID NO: 4865 - DNA, 9 bp, Artificial Sequence
  Synthetic oligonucleotide
gtgtgagga

SEQ ID NO: 4866 - DNA, 9 bp, Artificial Sequence
  Synthetic oligonucleotide
gagtgaaga

SEQ ID NO: 4867 - DNA, 9 bp, Artificial Sequence
  Synthetic oligonucleotide
gagtgatga

SEQ ID NO: 4868 - DNA, 9 bp, Artificial Sequence
  Synthetic oligonucleotide
gagtgagaa

SEQ ID NO: 4869 - DNA, 9 bp, Artificial Sequence
  Synthetic oligonucleotide
aagtgagga

SEQ ID NO: 4870 - DNA, 9 bp, Artificial Sequence
  Synthetic oligonucleotide
gagggagga

SEQ ID NO: 4871 - DNA, 9 bp, Artificial Sequence
  Synthetic oligonucleotide
gagtgaggc

SEQ ID NO: 4872 - DNA, 9 bp, Artificial Sequence
  Synthetic oligonucleotide
gagtgaggg

SEQ ID NO: 4873 - DNA, 9 bp, Artificial Sequence
  Synthetic oligonucleotide
gagtgaggg

SEQ ID NO: 4874 - DNA, 9 bp, Artificial Sequence
  Synthetic oligonucleotide
tagtgagga

SEQ ID NO: 4875 - DNA, 9 bp, Artificial Sequence
  Synthetic oligonucleotide
gactgagga

SEQ ID NO: 4876 - DNA, 9 bp, Artificial Sequence
  Synthetic oligonucleotide
gagtgagaa

SEQ ID NO: 4877 - DNA, 9 bp, Artificial Sequence
  Synthetic oligonucleotide
gagggagga

SEQ ID NO: 4878 - DNA, 9 bp, Artificial Sequence
  Synthetic oligonucleotide
gagtgatga

SEQ ID NO: 4879 - DNA, 9 bp, Artificial Sequence
  Synthetic oligonucleotide
gagtgaggg

SEQ ID NO: 4880 - DNA, 9 bp, Artificial Sequence
  Synthetic oligonucleotide
gagagagga

SEQ ID NO: 4881 - DNA, 9 bp, Artificial Sequence
  Synthetic oligonucleotide
gagtgagaa

SEQ ID NO: 4882 - DNA, 9 bp, Artificial Sequence
  Synthetic oligonucleotide
cagtgagga

SEQ ID NO: 4883 - DNA, 9 bp, Artificial Sequence
  Synthetic oligonucleotide
gagtgtgga

SEQ ID NO: 4884 - DNA, 9 bp, Artificial Sequence
  Synthetic oligonucleotide
aagtgagga

SEQ ID NO: 4885 - DNA, 9 bp, Artificial Sequence
  Synthetic oligonucleotide
gagagagga

SEQ ID NO: 4886 - DNA, 9 bp, Artificial Sequence
  Synthetic oligonucleotide
aagtgagga

SEQ ID NO: 4887 - DNA, 9 bp, Artificial Sequence
  Synthetic oligonucleotide
gagggagga

SEQ ID NO: 4888 - DNA, 9 bp, Artificial Sequence
  Synthetic oligonucleotide
gggtgagga

SEQ ID NO: 4889 - DNA, 9 bp, Artificial Sequence
  Synthetic oligonucleotide
aagtgagga

SEQ ID NO: 4890 - DNA, 9 bp, Artificial Sequence
  Synthetic oligonucleotide
aagtgagga

SEQ ID NO: 4891 - DNA, 9 bp, Artificial Sequence
  Synthetic oligonucleotide
aagtgagga

SEQ ID NO: 4892 - DNA, 9 bp, Artificial Sequence
  Synthetic oligonucleotide
aagtgagga

SEQ ID NO: 4893 - DNA, 9 bp, Artificial Sequence
  Synthetic oligonucleotide
tagtgagga

SEQ ID NO: 4894 - DNA, 9 bp, Artificial Sequence
  Synthetic oligonucleotide
gggtgagga

SEQ ID NO: 4895 - DNA, 9 bp, Artificial Sequence
  Synthetic oligonucleotide
gagggagga

SEQ ID NO: 4896 - DNA, 9 bp, Artificial Sequence
  Synthetic oligonucleotide
gagggagga

SEQ ID NO: 4897 - DNA, 9 bp, Artificial Sequence
  Synthetic oligonucleotide
gagggagga

SEQ ID NO: 4898 - DNA, 9 bp, Artificial Sequence
  Synthetic oligonucleotide
gagagagga

SEQ ID NO: 4899 - DNA, 9 bp, Artificial Sequence
  Synthetic oligonucleotide
aagtgagga

SEQ ID NO: 4900 - DNA, 9 bp, Artificial Sequence
  Synthetic oligonucleotide
aagtgagga

SEQ ID NO: 4901 - DNA, 9 bp, Artificial Sequence
  Synthetic oligonucleotide
gagtgtgga

SEQ ID NO: 4902 - DNA, 9 bp, Artificial Sequence
  Synthetic oligonucleotide
gagggagga

SEQ ID NO: 4903 - DNA, 9 bp, Artificial Sequence
  Synthetic oligonucleotide
gagcgagga

SEQ ID NO: 4904 - DNA, 9 bp, Artificial Sequence
  Synthetic oligonucleotide
gagtgaggt

SEQ ID NO: 4905 - DNA, 9 bp, Artificial Sequence
  Synthetic oligonucleotide
cagtgagga

SEQ ID NO: 4906 - DNA, 9 bp, Artificial Sequence
  Synthetic oligonucleotide
gagtgagta

SEQ ID NO: 4907 - DNA, 9 bp, Artificial Sequence
  Synthetic oligonucleotide
gagggagga

SEQ ID NO: 4908 - DNA, 9 bp, Artificial Sequence
  Synthetic oligonucleotide
gggtgagga

SEQ ID NO: 4909 - DNA, 9 bp, Artificial Sequence
  Synthetic oligonucleotide
tagtgagga

SEQ ID NO: 4910 - DNA, 9 bp, Artificial Sequence
  Synthetic oligonucleotide
aagtgagga

SEQ ID NO: 4911 - DNA, 9 bp, Artificial Sequence
  Synthetic oligonucleotide
gagtgggga

SEQ ID NO: 4912 - DNA, 9 bp, Artificial Sequence
  Synthetic oligonucleotide
gagtgagca

SEQ ID NO: 4913 - DNA, 9 bp, Artificial Sequence
  Synthetic oligonucleotide
gagtgagga

SEQ ID NO: 4914 - DNA, 9 bp, Artificial Sequence
  Synthetic oligonucleotide
gagtgagga

SEQ ID NO: 4915 - DNA, 9 bp, Artificial Sequence
  Synthetic oligonucleotide
gagtgagga

SEQ ID NO: 4916 - DNA, 9 bp, Artificial Sequence
  Synthetic oligonucleotide
gagtgagga

SEQ ID NO: 4917 - DNA, 9 bp, Artificial Sequence
  Synthetic oligonucleotide
gagtgagga

SEQ ID NO: 4918 - DNA, 9 bp, Artificial Sequence
  Synthetic oligonucleotide
gagtgagga

SEQ ID NO: 4919 - DNA, 9 bp, Artificial Sequence
  Synthetic oligonucleotide
gagtgagga

SEQ ID NO: 4920 - DNA, 9 bp, Artificial Sequence
  Synthetic oligonucleotide
gagtgagga

SEQ ID NO: 4921 - DNA, 9 bp, Artificial Sequence
  Synthetic oligonucleotide
gagtgagga

SEQ ID NO: 4922 - DNA, 9 bp, Artificial Sequence
  Synthetic oligonucleotide
gagtgagga

SEQ ID NO: 4923 - DNA, 9 bp, Artificial Sequence
  Synthetic oligonucleotide
gagtgagga

SEQ ID NO: 4924 - DNA, 9 bp, Artificial Sequence
  Synthetic oligonucleotide
gagtgagga

SEQ ID NO: 4925 - DNA, 9 bp, Artificial Sequence
  Synthetic oligonucleotide
gagtgagga

SEQ ID NO: 4926 - DNA, 9 bp, Artificial Sequence
  Synthetic oligonucleotide
gagtgagga

SEQ ID NO: 4927 - DNA, 9 bp, Artificial Sequence
  Synthetic oligonucleotide
gagtgagga

SEQ ID NO: 4928 - DNA, 9 bp, Artificial Sequence
  Synthetic oligonucleotide
gagtgagga

SEQ ID NO: 4929 - DNA, 9 bp, Artificial Sequence
  Synthetic oligonucleotide
gagtgagga

SEQ ID NO: 4930 - DNA, 9 bp, Artificial Sequence
  Synthetic oligonucleotide
gagtgagga

SEQ ID NO: 4931 - DNA, 9 bp, Artificial Sequence
  Synthetic oligonucleotide
gagtgagga

SEQ ID NO: 4932 - DNA, 9 bp, Artificial Sequence
  Synthetic oligonucleotide
gagtgagga

SEQ ID NO: 4933 - DNA, 9 bp, Artificial Sequence
  Synthetic oligonucleotide
gagtgagga

SEQ ID NO: 4934 - DNA, 9 bp, Artificial Sequence
  Synthetic oligonucleotide
gagtgagga

SEQ ID NO: 4935 - DNA, 9 bp, Artificial Sequence
  Synthetic oligonucleotide
gagtgagga

SEQ ID NO: 4936 - DNA, 9 bp, Artificial Sequence
  Synthetic oligonucleotide
gagtgagga

SEQ ID NO: 4937 - DNA, 9 bp, Artificial Sequence
  Synthetic oligonucleotide
gagtgagga

SEQ ID NO: 4938 - DNA, 9 bp, Artificial Sequence
  Synthetic oligonucleotide
gagtgagga

SEQ ID NO: 4939 - DNA, 9 bp, Artificial Sequence
  Synthetic oligonucleotide
gagtgagga

SEQ ID NO: 4940 - DNA, 9 bp, Artificial Sequence
  Synthetic oligonucleotide
gagtgagga

SEQ ID NO: 4941 - DNA, 9 bp, Artificial Sequence
  Synthetic oligonucleotide
gagtgagga

SEQ ID NO: 4942 - DNA, 9 bp, Artificial Sequence
  Synthetic oligonucleotide
gagtgagga

SEQ ID NO: 4943 - DNA, 9 bp, Artificial Sequence
  Synthetic oligonucleotide
gagtgagga

SEQ ID NO: 4944 - DNA, 9 bp, Artificial Sequence
  Synthetic oligonucleotide
gagtgagga

SEQ ID NO: 4945 - DNA, 9 bp, Artificial Sequence
  Synthetic oligonucleotide
gagtgagga

SEQ ID NO: 4946 - DNA, 9 bp, Artificial Sequence
  Synthetic oligonucleotide
gagtgagga

SEQ ID NO: 4947 - DNA, 9 bp, Artificial Sequence
  Synthetic oligonucleotide
gagtgagga

SEQ ID NO: 4948 - DNA, 9 bp, Artificial Sequence
  Synthetic oligonucleotide
gagtgagga

SEQ ID NO: 4949 - DNA, 9 bp, Artificial Sequence
  Synthetic oligonucleotide
gagtgagga

SEQ ID NO: 4950 - DNA, 9 bp, Artificial Sequence
  Synthetic oligonucleotide
gagtgagga

SEQ ID NO: 4951 - DNA, 9 bp, Artificial Sequence
  Synthetic oligonucleotide
gagtgagga

SEQ ID NO: 4952 - DNA, 9 bp, Artificial Sequence
  Synthetic oligonucleotide
gagtgagga

SEQ ID NO: 4953 - DNA, 9 bp, Artificial Sequence
  Synthetic oligonucleotide
gagtgagga

SEQ ID NO: 4954 - DNA, 9 bp, Artificial Sequence
  Synthetic oligonucleotide
gagtgagga

SEQ ID NO: 4955 - DNA, 9 bp, Artificial Sequence
  Synthetic oligonucleotide
gagtgagga

SEQ ID NO: 4956 - DNA, 9 bp, Artificial Sequence
  Synthetic oligonucleotide
gagtgagga

SEQ ID NO: 4957 - DNA, 9 bp, Artificial Sequence
  Synthetic oligonucleotide
gagtgagga

SEQ ID NO: 4958 - DNA, 9 bp, Artificial Sequence
  Synthetic oligonucleotide
gagtgagga

SEQ ID NO: 4959 - DNA, 9 bp, Artificial Sequence
  Synthetic oligonucleotide
gagtgagga

SEQ ID NO: 4960 - DNA, 9 bp, Artificial Sequence
  Synthetic oligonucleotide
gagtgagga

SEQ ID NO: 4961 - DNA, 9 bp, Artificial Sequence
  Synthetic oligonucleotide
gagtgagga

SEQ ID NO: 4962 - DNA, 9 bp, Artificial Sequence
  Synthetic oligonucleotide
gagtgagga

SEQ ID NO: 4963 - DNA, 9 bp, Artificial Sequence
  Synthetic oligonucleotide
gagtgagga

SEQ ID NO: 4964 - DNA, 9 bp, Artificial Sequence
  Synthetic oligonucleotide
gagtgagga

SEQ ID NO: 4965 - DNA, 9 bp, Artificial Sequence
  Synthetic oligonucleotide
gagtgagga

SEQ ID NO: 4966 - DNA, 9 bp, Artificial Sequence
  Synthetic oligonucleotide
gagtgagga

SEQ ID NO: 4967 - DNA, 9 bp, Artificial Sequence
  Synthetic oligonucleotide
gagtgagga

SEQ ID NO: 4968 - DNA, 9 bp, Artificial Sequence
  Synthetic oligonucleotide
gagtgagga

SEQ ID NO: 4969 - DNA, 9 bp, Artificial Sequence
  Synthetic oligonucleotide
gagtgagga

SEQ ID NO: 4970 - DNA, 9 bp, Artificial Sequence
  Synthetic oligonucleotide
gagtgagga

SEQ ID NO: 4971 - DNA, 9 bp, Artificial Sequence
  Synthetic oligonucleotide
gagtgagga

SEQ ID NO: 4972 - DNA, 9 bp, Artificial Sequence
  Synthetic oligonucleotide
gagtgagga

SEQ ID NO: 4973 - DNA, 9 bp, Artificial Sequence
  Synthetic oligonucleotide
gagtgagga

SEQ ID NO: 4974 - DNA, 9 bp, Artificial Sequence
  Synthetic oligonucleotide
gagtgagga

SEQ ID NO: 4975 - DNA, 9 bp, Artificial Sequence
  Synthetic oligonucleotide
gagtgagga

SEQ ID NO: 4976 - DNA, 9 bp, Artificial Sequence
  Synthetic oligonucleotide
gagtgagga

SEQ ID NO: 4977 - DNA, 9 bp, Artificial Sequence
  Synthetic oligonucleotide
gagtgagga

SEQ ID NO: 4978 - DNA, 9 bp, Artificial Sequence
  Synthetic oligonucleotide
gagtgagga

SEQ ID NO: 4979 - DNA, 9 bp, Artificial Sequence
  Synthetic oligonucleotide
gagtgagga

SEQ ID NO: 4980 - DNA, 9 bp, Artificial Sequence
  Synthetic oligonucleotide
gagtgagga

SEQ ID NO: 4981 - DNA, 9 bp, Artificial Sequence
  Synthetic oligonucleotide
gagtgagga

SEQ ID NO: 4982 - DNA, 9 bp, Artificial Sequence
  Synthetic oligonucleotide
gagtgagga

SEQ ID NO: 4983 - DNA, 9 bp, Artificial Sequence
  Synthetic oligonucleotide
gagtgagga

SEQ ID NO: 4984 - DNA, 9 bp, Artificial Sequence
  Synthetic oligonucleotide
gagtgagga

SEQ ID NO: 4985 - DNA, 9 bp, Artificial Sequence
  Synthetic oligonucleotide
gagtgagga

SEQ ID NO: 4986 - DNA, 9 bp, Artificial Sequence
  Synthetic oligonucleotide
gagtgagga

SEQ ID NO: 4987 - DNA, 9 bp, Artificial Sequence
  Synthetic oligonucleotide
gagtgagga

SEQ ID NO: 4988 - DNA, 9 bp, Artificial Sequence
  Synthetic oligonucleotide
gagtgagga

SEQ ID NO: 4989 - DNA, 9 bp, Artificial Sequence
  Synthetic oligonucleotide
gagtgagga

SEQ ID NO: 4990 - DNA, 9 bp, Artificial Sequence
  Synthetic oligonucleotide
gagtgagga

SEQ ID NO: 4991 - DNA, 9 bp, Artificial Sequence
  Synthetic oligonucleotide
gagtgagga

SEQ ID NO: 4992 - DNA, 9 bp, Artificial Sequence
  Synthetic oligonucleotide
gagtgagga

SEQ ID NO: 4993 - DNA, 9 bp, Artificial Sequence
  Synthetic oligonucleotide
gagtgagga

SEQ ID NO: 4994 - DNA, 9 bp, Artificial Sequence
  Synthetic oligonucleotide
gagtgagga

SEQ ID NO: 4995 - DNA, 9 bp, Artificial Sequence
  Synthetic oligonucleotide
gagtgagga

SEQ ID NO: 4996 - DNA, 9 bp, Artificial Sequence
  Synthetic oligonucleotide
gagtgagga

SEQ ID NO: 4997 - DNA, 9 bp, Artificial Sequence
  Synthetic oligonucleotide
gagtgagga

SEQ ID NO: 4998 - DNA, 9 bp, Artificial Sequence
  Synthetic oligonucleotide
gagtgagga

SEQ ID NO: 4999 - DNA, 9 bp, Artificial Sequence
  Synthetic oligonucleotide
gagtgagga

SEQ ID NO: 5000 - DNA, 9 bp, Artificial Sequence
  Synthetic oligonucleotide
gagtgagga

SEQ ID NO: 5001 - DNA, 9 bp, Artificial Sequence
  Synthetic oligonucleotide
gagtgagga

SEQ ID NO: 5002 - DNA, 9 bp, Artificial Sequence
  Synthetic oligonucleotide
gagtgagga

SEQ ID NO: 5003 - DNA, 9 bp, Artificial Sequence
  Synthetic oligonucleotide
gagtgagga

SEQ ID NO: 5004 - DNA, 9 bp, Artificial Sequence
  Synthetic oligonucleotide
gagtgagga

SEQ ID NO: 5005 - DNA, 9 bp, Artificial Sequence
  Synthetic oligonucleotide
gagtgagga

SEQ ID NO: 5006 - DNA, 9 bp, Artificial Sequence
  Synthetic oligonucleotide
gagtgagga

SEQ ID NO: 5007 - DNA, 9 bp, Artificial Sequence
  Synthetic oligonucleotide
gagtgagga

SEQ ID NO: 5008 - DNA, 9 bp, Artificial Sequence
  Synthetic oligonucleotide
gagtgagga

SEQ ID NO: 5009 - DNA, 9 bp, Artificial Sequence
  Synthetic oligonucleotide
gagtgagga

SEQ ID NO: 5010 - DNA, 9 bp, Artificial Sequence
  Synthetic oligonucleotide
gagtgagga

SEQ ID NO: 5011 - DNA, 9 bp, Artificial Sequence
  Synthetic oligonucleotide
gagtgagga

SEQ ID NO: 5012 - DNA, 9 bp, Artificial Sequence
  Synthetic oligonucleotide
gagtgagga

SEQ ID NO: 5013 - DNA, 9 bp, Artificial Sequence
  Synthetic oligonucleotide
gagtgagga

SEQ ID NO: 5014 - DNA, 9 bp, Artificial Sequence
  Synthetic oligonucleotide
gagtgagga

SEQ ID NO: 5015 - DNA, 9 bp, Artificial Sequence
  Synthetic oligonucleotide
gagtgagga

SEQ ID NO: 5016 - DNA, 9 bp, Artificial Sequence
  Synthetic oligonucleotide
gagtgagga

SEQ ID NO: 5017 - DNA, 9 bp, Artificial Sequence
  Synthetic oligonucleotide
gagtgagga

SEQ ID NO: 5018 - DNA, 9 bp, Artificial Sequence
  Synthetic oligonucleotide
gagtgagga

SEQ ID NO: 5019 - DNA, 9 bp, Artificial Sequence
  Synthetic oligonucleotide
gagtgagga

SEQ ID NO: 5020 - DNA, 9 bp, Artificial Sequence
  Synthetic oligonucleotide
gagtgagga

SEQ ID NO: 5021 - DNA, 9 bp, Artificial Sequence
  Synthetic oligonucleotide
gagtgagga

SEQ ID NO: 5022 - DNA, 9 bp, Artificial Sequence
  Synthetic oligonucleotide
gactcatgt

SEQ ID NO: 5023 - DNA, 9 bp, Artificial Sequence
  Synthetic oligonucleotide
tagtggagc

SEQ ID NO: 5024 - DNA, 9 bp, Artificial Sequence
  Synthetic oligonucleotide
gtgggagtc

SEQ ID NO: 5025 - DNA, 9 bp, Artificial Sequence
  Synthetic oligonucleotide
ggcggaggc

SEQ ID NO: 5026 - DNA, 9 bp, Artificial Sequence
  Synthetic oligonucleotide
aggtgacaa

SEQ ID NO: 5027 - DNA, 9 bp, Artificial Sequence
  Synthetic oligonucleotide
gggagacca

SEQ ID NO: 5028 - DNA, 9 bp, Artificial Sequence
  Synthetic oligonucleotide
aagacatga

SEQ ID NO: 5029 - DNA, 9 bp, Artificial Sequence
  Synthetic oligonucleotide
catggagca

SEQ ID NO: 5030 - DNA, 9 bp, Artificial Sequence
  Synthetic oligonucleotide
cagtgaaac

SEQ ID NO: 5031 - DNA, 9 bp, Artificial Sequence
  Synthetic oligonucleotide
gtgtgctgc

SEQ ID NO: 5032 - DNA, 9 bp, Artificial Sequence
  Synthetic oligonucleotide
ggtagagca

SEQ ID NO: 5033 - DNA, 9 bp, Artificial Sequence
  Synthetic oligonucleotide
catggagca

SEQ ID NO: 5034 - DNA, 9 bp, Artificial Sequence
  Synthetic oligonucleotide
agggcagga

SEQ ID NO: 5035 - DNA, 9 bp, Artificial Sequence
  Synthetic oligonucleotide
gagcgcgtc

SEQ ID NO: 5036 - DNA, 9 bp, Artificial Sequence
  Synthetic oligonucleotide
ggctgagat

SEQ ID NO: 5037 - DNA, 9 bp, Artificial Sequence
  Synthetic oligonucleotide
gtgggagcc

SEQ ID NO: 5038 - DNA, 9 bp, Artificial Sequence
  Synthetic oligonucleotide
tggtaagca

SEQ ID NO: 5039 - DNA, 9 bp, Artificial Sequence
  Synthetic oligonucleotide
gtgtgttgc

SEQ ID NO: 5040 - DNA, 9 bp, Artificial Sequence
  Synthetic oligonucleotide
aattgagtt

SEQ ID NO: 5041 - DNA, 9 bp, Artificial Sequence
  Synthetic oligonucleotide
gtgagttga

SEQ ID NO: 5042 - DNA, 9 bp, Artificial Sequence
  Synthetic oligonucleotide
gtgtgctgc

SEQ ID NO: 5043 - DNA, 9 bp, Artificial Sequence
  Synthetic oligonucleotide
gactgccgt

SEQ ID NO: 5044 - DNA, 9 bp, Artificial Sequence
  Synthetic oligonucleotide
catggagca

SEQ ID NO: 5045 - DNA, 9 bp, Artificial Sequence
  Synthetic oligonucleotide
gagcggtgc

SEQ ID NO: 5046 - DNA, 9 bp, Artificial Sequence
  Synthetic oligonucleotide
ggcagaggt

SEQ ID NO: 5047 - DNA, 9 bp, Artificial Sequence
  Synthetic oligonucleotide
ccgctagga

SEQ ID NO: 5048 - DNA, 9 bp, Artificial Sequence
  Synthetic oligonucleotide
gagggcggc

SEQ ID NO: 5049 - DNA, 9 bp, Artificial Sequence
  Synthetic oligonucleotide
gtgtgaagg

SEQ ID NO: 5050 - DNA, 9 bp, Artificial Sequence
  Synthetic oligonucleotide
aagtgagcc

SEQ ID NO: 5051 - DNA, 9 bp, Artificial Sequence
  Synthetic oligonucleotide
cagtgaaaa

SEQ ID NO: 5052 - DNA, 9 bp, Artificial Sequence
  Synthetic oligonucleotide
cagtgtggt

SEQ ID NO: 5053 - DNA, 9 bp, Artificial Sequence
  Synthetic oligonucleotide
gagcctgga

SEQ ID NO: 5054 - DNA, 9 bp, Artificial Sequence
  Synthetic oligonucleotide
gtgtgagag

SEQ ID NO: 5055 - DNA, 9 bp, Artificial Sequence
  Synthetic oligonucleotide
gagaggggc

SEQ ID NO: 5056 - DNA, 9 bp, Artificial Sequence
  Synthetic oligonucleotide
gtctcagga

SEQ ID NO: 5057 - DNA, 9 bp, Artificial Sequence
  Synthetic oligonucleotide
gtctcagga

SEQ ID NO: 5058 - DNA, 9 bp, Artificial Sequence
  Synthetic oligonucleotide
gtgtgagtg

SEQ ID NO: 5059 - DNA, 9 bp, Artificial Sequence
  Synthetic oligonucleotide
gtctcagga

SEQ ID NO: 5060 - DNA, 9 bp, Artificial Sequence
  Synthetic oligonucleotide
gagtgatat

SEQ ID NO: 5061 - DNA, 9 bp, Artificial Sequence
  Synthetic oligonucleotide
gtgtaaggt

SEQ ID NO: 5062 - DNA, 9 bp, Artificial Sequence
  Synthetic oligonucleotide
gtctcagga

SEQ ID NO: 5063 - DNA, 9 bp, Artificial Sequence
  Synthetic oligonucleotide
gtctcagga

SEQ ID NO: 5064 - DNA, 9 bp, Artificial Sequence
  Synthetic oligonucleotide
tggtgaggg

SEQ ID NO: 5065 - DNA, 9 bp, Artificial Sequence
  Synthetic oligonucleotide
gtctcagga

SEQ ID NO: 5066 - DNA, 9 bp, Artificial Sequence
  Synthetic oligonucleotide
ctgtgaggc

SEQ ID NO: 5067 - DNA, 9 bp, Artificial Sequence
  Synthetic oligonucleotide
gagggcggc

SEQ ID NO: 5068 - DNA, 9 bp, Artificial Sequence
  Synthetic oligonucleotide
gagagagcc

SEQ ID NO: 5069 - DNA, 9 bp, Artificial Sequence
  Synthetic oligonucleotide
ttgtgaggg

SEQ ID NO: 5070 - DNA, 9 bp, Artificial Sequence
  Synthetic oligonucleotide
gtctcagga

SEQ ID NO: 5071 - DNA, 9 bp, Artificial Sequence
  Synthetic oligonucleotide
gtctcagga

SEQ ID NO: 5072 - DNA, 9 bp, Artificial Sequence
  Synthetic oligonucleotide
tagtgagtc

SEQ ID NO: 5073 - DNA, 9 bp, Artificial Sequence
  Synthetic oligonucleotide
tggtgaggc

SEQ ID NO: 5074 - DNA, 9 bp, Artificial Sequence
  Synthetic oligonucleotide
gtctcagga

SEQ ID NO: 5075 - DNA, 9 bp, Artificial Sequence
  Synthetic oligonucleotide
gaggaaggg

SEQ ID NO: 5076 - DNA, 9 bp, Artificial Sequence
  Synthetic oligonucleotide
gagcaagaa

SEQ ID NO: 5077 - DNA, 9 bp, Artificial Sequence
  Synthetic oligonucleotide
aagtgtggt

SEQ ID NO: 5078 - DNA, 9 bp, Artificial Sequence
  Synthetic oligonucleotide
gtctcagga

SEQ ID NO: 5079 - DNA, 9 bp, Artificial Sequence
  Synthetic oligonucleotide
ggttgaggc

SEQ ID NO: 5080 - DNA, 9 bp, Artificial Sequence
  Synthetic oligonucleotide
gggagaggc

SEQ ID NO: 5081 - DNA, 9 bp, Artificial Sequence
  Synthetic oligonucleotide
ggaggagga

SEQ ID NO: 5082 - DNA, 9 bp, Artificial Sequence
  Synthetic oligonucleotide
gtctcagga

SEQ ID NO: 5083 - DNA, 9 bp, Artificial Sequence
  Synthetic oligonucleotide
gactgaaca

SEQ ID NO: 5084 - DNA, 9 bp, Artificial Sequence
  Synthetic oligonucleotide
gagggagcc

SEQ ID NO: 5085 - DNA, 9 bp, Artificial Sequence
  Synthetic oligonucleotide
aagggaggt

SEQ ID NO: 5086 - DNA, 9 bp, Artificial Sequence
  Synthetic oligonucleotide
gagtgtcgt

SEQ ID NO: 5087 - DNA, 9 bp, Artificial Sequence
  Synthetic oligonucleotide
gtgtgagct

SEQ ID NO: 5088 - DNA, 9 bp, Artificial Sequence
  Synthetic oligonucleotide
gagtgaaag

SEQ ID NO: 5089 - DNA, 9 bp, Artificial Sequence
  Synthetic oligonucleotide
aggtgaggt

SEQ ID NO: 5090 - DNA, 9 bp, Artificial Sequence
  Synthetic oligonucleotide
ggaggagga

SEQ ID NO: 5091 - DNA, 9 bp, Artificial Sequence
  Synthetic oligonucleotide
gtgggaggt

SEQ ID NO: 5092 - DNA, 9 bp, Artificial Sequence
  Synthetic oligonucleotide
tggtgaggc

SEQ ID NO: 5093 - DNA, 9 bp, Artificial Sequence
  Synthetic oligonucleotide
gagagatgg

SEQ ID NO: 5094 - DNA, 9 bp, Artificial Sequence
  Synthetic oligonucleotide
gtctcagga

SEQ ID NO: 5095 - DNA, 9 bp, Artificial Sequence
  Synthetic oligonucleotide
gagttgaga

SEQ ID NO: 5096 - DNA, 9 bp, Artificial Sequence
  Synthetic oligonucleotide
aattgagca

SEQ ID NO: 5097 - DNA, 9 bp, Artificial Sequence
  Synthetic oligonucleotide
gagtaggca

SEQ ID NO: 5098 - DNA, 9 bp, Artificial Sequence
  Synthetic oligonucleotide
tagggaggt

SEQ ID NO: 5099 - DNA, 9 bp, Artificial Sequence
  Synthetic oligonucleotide
ggaggagga

SEQ ID NO: 5100 - DNA, 9 bp, Artificial Sequence
  Synthetic oligonucleotide
gagtgaatt

SEQ ID NO: 5101 - DNA, 9 bp, Artificial Sequence
  Synthetic oligonucleotide
gtctcagga

SEQ ID NO: 5102 - DNA, 9 bp, Artificial Sequence
  Synthetic oligonucleotide
gactgagtc

SEQ ID NO: 5103 - DNA, 9 bp, Artificial Sequence
  Synthetic oligonucleotide
gagggagat

SEQ ID NO: 5104 - DNA, 9 bp, Artificial Sequence
  Synthetic oligonucleotide
gtatgaggc

SEQ ID NO: 5105 - DNA, 9 bp, Artificial Sequence
  Synthetic oligonucleotide
tggtgaggc

SEQ ID NO: 5106 - DNA, 9 bp, Artificial Sequence
  Synthetic oligonucleotide
gtctcagga

SEQ ID NO: 5107 - DNA, 9 bp, Artificial Sequence
  Synthetic oligonucleotide
gtctcagga

SEQ ID NO: 5108 - DNA, 9 bp, Artificial Sequence
  Synthetic oligonucleotide
gtctcagga

SEQ ID NO: 5109 - DNA, 9 bp, Artificial Sequence
  Synthetic oligonucleotide
gagtgattt

SEQ ID NO: 5110 - DNA, 9 bp, Artificial Sequence
  Synthetic oligonucleotide
gagtgaatt

SEQ ID NO: 5111 - DNA, 9 bp, Artificial Sequence
  Synthetic oligonucleotide
gtctcagga

SEQ ID NO: 5112 - DNA, 9 bp, Artificial Sequence
  Synthetic oligonucleotide
gtctcagga

SEQ ID NO: 5113 - DNA, 9 bp, Artificial Sequence
  Synthetic oligonucleotide
gagtaggca

SEQ ID NO: 5114 - DNA, 9 bp, Artificial Sequence
  Synthetic oligonucleotide
gagtaagct

SEQ ID NO: 5115 - DNA, 9 bp, Artificial Sequence
  Synthetic oligonucleotide
gtctcagga

SEQ ID NO: 5116 - DNA, 9 bp, Artificial Sequence
  Synthetic oligonucleotide
gtctcagga

SEQ ID NO: 5117 - DNA, 9 bp, Artificial Sequence
  Synthetic oligonucleotide
gggagtgga

SEQ ID NO: 5118 - DNA, 9 bp, Artificial Sequence
  Synthetic oligonucleotide
gagggaaaa

SEQ ID NO: 5119 - DNA, 9 bp, Artificial Sequence
  Synthetic oligonucleotide
aggtgagaa

SEQ ID NO: 5120 - DNA, 9 bp, Artificial Sequence
  Synthetic oligonucleotide
aagtgtggt

SEQ ID NO: 5121 - DNA, 9 bp, Artificial Sequence
  Synthetic oligonucleotide
aggtgagaa

SEQ ID NO: 5122 - DNA, 9 bp, Artificial Sequence
  Synthetic oligonucleotide
cagagaggt

SEQ ID NO: 5123 - DNA, 9 bp, Artificial Sequence
  Synthetic oligonucleotide
aagagaggg

SEQ ID NO: 5124 - DNA, 9 bp, Artificial Sequence
  Synthetic oligonucleotide
gtgtgagag

SEQ ID NO: 5125 - DNA, 9 bp, Artificial Sequence
  Synthetic oligonucleotide
aggtgagaa

SEQ ID NO: 5126 - DNA, 9 bp, Artificial Sequence
  Synthetic oligonucleotide
aggtgagaa

SEQ ID NO: 5127 - DNA, 9 bp, Artificial Sequence
  Synthetic oligonucleotide
aggtgagaa

SEQ ID NO: 5128 - DNA, 9 bp, Artificial Sequence
  Synthetic oligonucleotide
aggtgagaa

SEQ ID NO: 5129 - DNA, 9 bp, Artificial Sequence
  Synthetic oligonucleotide
gaggaaggg

SEQ ID NO: 5130 - DNA, 9 bp, Artificial Sequence
  Synthetic oligonucleotide
gtctcagga

SEQ ID NO: 5131 - DNA, 9 bp, Artificial Sequence
  Synthetic oligonucleotide
gggtgaagc

SEQ ID NO: 5132 - DNA, 9 bp, Artificial Sequence
  Synthetic oligonucleotide
gtctcagga

SEQ ID NO: 5133 - DNA, 9 bp, Artificial Sequence
  Synthetic oligonucleotide
gagtgaatt

SEQ ID NO: 5134 - DNA, 9 bp, Artificial Sequence
  Synthetic oligonucleotide
gtctcagga

SEQ ID NO: 5135 - DNA, 9 bp, Artificial Sequence
  Synthetic oligonucleotide
gtctcagga

SEQ ID NO: 5136 - DNA, 9 bp, Artificial Sequence
  Synthetic oligonucleotide
gggtgagtg

SEQ ID NO: 5137 - DNA, 9 bp, Artificial Sequence
  Synthetic oligonucleotide
gtgtggggt

SEQ ID NO: 5138 - DNA, 9 bp, Artificial Sequence
  Synthetic oligonucleotide
tagtgttga

SEQ ID NO: 5139 - DNA, 9 bp, Artificial Sequence
  Synthetic oligonucleotide
gaataaaga

SEQ ID NO: 5140 - DNA, 9 bp, Artificial Sequence
  Synthetic oligonucleotide
gtctcagga

SEQ ID NO: 5141 - DNA, 9 bp, Artificial Sequence
  Synthetic oligonucleotide
gggagtgga

SEQ ID NO: 5142 - DNA, 9 bp, Artificial Sequence
  Synthetic oligonucleotide
gaggaaggc

SEQ ID NO: 5143 - DNA, 9 bp, Artificial Sequence
  Synthetic oligonucleotide
gtctcagga

SEQ ID NO: 5144 - DNA, 9 bp, Artificial Sequence
  Synthetic oligonucleotide
aagagtgga

SEQ ID NO: 5145 - DNA, 9 bp, Artificial Sequence
  Synthetic oligonucleotide
aagtgagcc

SEQ ID NO: 5146 - DNA, 9 bp, Artificial Sequence
  Synthetic oligonucleotide
gagtaggca

SEQ ID NO: 5147 - DNA, 9 bp, Artificial Sequence
  Synthetic oligonucleotide
ctgtgaggc

SEQ ID NO: 5148 - DNA, 9 bp, Artificial Sequence
  Synthetic oligonucleotide
gtctcagga

SEQ ID NO: 5149 - DNA, 9 bp, Artificial Sequence
  Synthetic oligonucleotide
gtctcagga

SEQ ID NO: 5150 - DNA, 9 bp, Artificial Sequence
  Synthetic oligonucleotide
cagtgagat

SEQ ID NO: 5151 - DNA, 9 bp, Artificial Sequence
  Synthetic oligonucleotide
gaggaaaga

SEQ ID NO: 5152 - DNA, 9 bp, Artificial Sequence
  Synthetic oligonucleotide
aagtgagtc

SEQ ID NO: 5153 - DNA, 9 bp, Artificial Sequence
  Synthetic oligonucleotide
gagtgattt

SEQ ID NO: 5154 - DNA, 9 bp, Artificial Sequence
  Synthetic oligonucleotide
gtttcagga

SEQ ID NO: 5155 - DNA, 9 bp, Artificial Sequence
  Synthetic oligonucleotide
gtttcagga

SEQ ID NO: 5156 - DNA, 9 bp, Artificial Sequence
  Synthetic oligonucleotide
gaggtaggc

SEQ ID NO: 5157 - DNA, 9 bp, Artificial Sequence
  Synthetic oligonucleotide
tagtgagac

SEQ ID NO: 5158 - DNA, 9 bp, Artificial Sequence
  Synthetic oligonucleotide
gtctcagga

SEQ ID NO: 5159 - DNA, 9 bp, Artificial Sequence
  Synthetic oligonucleotide
gagtgggct

SEQ ID NO: 5160 - DNA, 9 bp, Artificial Sequence
  Synthetic oligonucleotide
gagcaggga

SEQ ID NO: 5161 - DNA, 9 bp, Artificial Sequence
  Synthetic oligonucleotide
tggtgaggg

SEQ ID NO: 5162 - DNA, 9 bp, Artificial Sequence
  Synthetic oligonucleotide
gagtgttgg

SEQ ID NO: 5163 - DNA, 9 bp, Artificial Sequence
  Synthetic oligonucleotide
tagtgtggt

SEQ ID NO: 5164 - DNA, 9 bp, Artificial Sequence
  Synthetic oligonucleotide
gtgtgagat

SEQ ID NO: 5165 - DNA, 9 bp, Artificial Sequence
  Synthetic oligonucleotide
gagggaggg

SEQ ID NO: 5166 - DNA, 9 bp, Artificial Sequence
  Synthetic oligonucleotide
gagtgagat

SEQ ID NO: 5167 - DNA, 9 bp, Artificial Sequence
  Synthetic oligonucleotide
gagagaggc

SEQ ID NO: 5168 - DNA, 9 bp, Artificial Sequence
  Synthetic oligonucleotide
gagtgagcc

SEQ ID NO: 5169 - DNA, 9 bp, Artificial Sequence
  Synthetic oligonucleotide
gagtaaggt

SEQ ID NO: 5170 - DNA, 9 bp, Artificial Sequence
  Synthetic oligonucleotide
aagtgagta

SEQ ID NO: 5171 - DNA, 9 bp, Artificial Sequence
  Synthetic oligonucleotide
gagggaggc

SEQ ID NO: 5172 - DNA, 9 bp, Artificial Sequence
  Synthetic oligonucleotide
gagtgtggg

SEQ ID NO: 5173 - DNA, 9 bp, Artificial Sequence
  Synthetic oligonucleotide
cagtgaggg

SEQ ID NO: 5174 - DNA, 9 bp, Artificial Sequence
  Synthetic oligonucleotide
tagtgaggg

SEQ ID NO: 5175 - DNA, 9 bp, Artificial Sequence
  Synthetic oligonucleotide
gagtaaggt

SEQ ID NO: 5176 - DNA, 9 bp, Artificial Sequence
  Synthetic oligonucleotide
gggtgaggg

SEQ ID NO: 5177 - DNA, 9 bp, Artificial Sequence
  Synthetic oligonucleotide
gagtgagat

SEQ ID NO: 5178 - DNA, 9 bp, Artificial Sequence
  Synthetic oligonucleotide
cagtgaggg

SEQ ID NO: 5179 - DNA, 9 bp, Artificial Sequence
  Synthetic oligonucleotide
gagtgagtc

SEQ ID NO: 5180 - DNA, 9 bp, Artificial Sequence
  Synthetic oligonucleotide
gagtgaaaa

SEQ ID NO: 5181 - DNA, 9 bp, Artificial Sequence
  Synthetic oligonucleotide
gagggaggt

SEQ ID NO: 5182 - DNA, 9 bp, Artificial Sequence
  Synthetic oligonucleotide
gagtgtgaa

SEQ ID NO: 5183 - DNA, 9 bp, Artificial Sequence
  Synthetic oligonucleotide
gagcgagta

SEQ ID NO: 5184 - DNA, 9 bp, Artificial Sequence
  Synthetic oligonucleotide
gtgtgaggc

SEQ ID NO: 5185 - DNA, 9 bp, Artificial Sequence
  Synthetic oligonucleotide
gagggaggc

SEQ ID NO: 5186 - DNA, 9 bp, Artificial Sequence
  Synthetic oligonucleotide
tagtgaggc

SEQ ID NO: 5187 - DNA, 9 bp, Artificial Sequence
  Synthetic oligonucleotide
cagtgaggg

SEQ ID NO: 5188 - DNA, 9 bp, Artificial Sequence
  Synthetic oligonucleotide
gagtgagat

SEQ ID NO: 5189 - DNA, 9 bp, Artificial Sequence
  Synthetic oligonucleotide
tagtgaggg

SEQ ID NO: 5190 - DNA, 9 bp, Artificial Sequence
  Synthetic oligonucleotide
gagtgagag

SEQ ID NO: 5191 - DNA, 9 bp, Artificial Sequence
  Synthetic oligonucleotide
gagtgagtg

SEQ ID NO: 5192 - DNA, 9 bp, Artificial Sequence
  Synthetic oligonucleotide
gagtgagac

SEQ ID NO: 5193 - DNA, 9 bp, Artificial Sequence
  Synthetic oligonucleotide
aagtgaggg

SEQ ID NO: 5194 - DNA, 9 bp, Artificial Sequence
  Synthetic oligonucleotide
gagggaggt

SEQ ID NO: 5195 - DNA, 9 bp, Artificial Sequence
  Synthetic oligonucleotide
gagggaggt

SEQ ID NO: 5196 - DNA, 9 bp, Artificial Sequence
  Synthetic oligonucleotide
gagagaggc

SEQ ID NO: 5197 - DNA, 9 bp, Artificial Sequence
  Synthetic oligonucleotide
gagtgaata

SEQ ID NO: 5198 - DNA, 9 bp, Artificial Sequence
  Synthetic oligonucleotide
gagtgagag

SEQ ID NO: 5199 - DNA, 9 bp, Artificial Sequence
  Synthetic oligonucleotide
gagggaggc

SEQ ID NO: 5200 - DNA, 9 bp, Artificial Sequence
  Synthetic oligonucleotide
gagagaggg

SEQ ID NO: 5201 - DNA, 9 bp, Artificial Sequence
  Synthetic oligonucleotide
tagtgaggc

SEQ ID NO: 5202 - DNA, 9 bp, Artificial Sequence
  Synthetic oligonucleotide
aagtgaggt

SEQ ID NO: 5203 - DNA, 9 bp, Artificial Sequence
  Synthetic oligonucleotide
gagggaggc

SEQ ID NO: 5204 - DNA, 9 bp, Artificial Sequence
  Synthetic oligonucleotide
gagtgtggt

SEQ ID NO: 5205 - DNA, 9 bp, Artificial Sequence
  Synthetic oligonucleotide
gagtgagat

SEQ ID NO: 5206 - DNA, 9 bp, Artificial Sequence
  Synthetic oligonucleotide
gggtgaggt

SEQ ID NO: 5207 - DNA, 9 bp, Artificial Sequence
  Synthetic oligonucleotide
gagtgagcc

SEQ ID NO: 5208 - DNA, 9 bp, Artificial Sequence
  Synthetic oligonucleotide
gagtgagcc

SEQ ID NO: 5209 - DNA, 9 bp, Artificial Sequence
  Synthetic oligonucleotide
gggtgaggg

SEQ ID NO: 5210 - DNA, 9 bp, Artificial Sequence
  Synthetic oligonucleotide
gagtgagcc

SEQ ID NO: 5211 - DNA, 9 bp, Artificial Sequence
  Synthetic oligonucleotide
gtgtgaggc

SEQ ID NO: 5212 - DNA, 9 bp, Artificial Sequence
  Synthetic oligonucleotide
gagtgacca

SEQ ID NO: 5213 - DNA, 9 bp, Artificial Sequence
  Synthetic oligonucleotide
cagtgaggg

SEQ ID NO: 5214 - DNA, 9 bp, Artificial Sequence
  Synthetic oligonucleotide
cagtgaggc

SEQ ID NO: 5215 - DNA, 9 bp, Artificial Sequence
  Synthetic oligonucleotide
cagtgaggg

SEQ ID NO: 5216 - DNA, 9 bp, Artificial Sequence
  Synthetic oligonucleotide
tagtgaggg

SEQ ID NO: 5217 - DNA, 9 bp, Artificial Sequence
  Synthetic oligonucleotide
gagtgatgt

SEQ ID NO: 5218 - DNA, 9 bp, Artificial Sequence
  Synthetic oligonucleotide
gagggaggt

SEQ ID NO: 5219 - DNA, 9 bp, Artificial Sequence
  Synthetic oligonucleotide
gagagaggg

SEQ ID NO: 5220 - DNA, 9 bp, Artificial Sequence
  Synthetic oligonucleotide
aagtgaggg

SEQ ID NO: 5221 - DNA, 9 bp, Artificial Sequence
  Synthetic oligonucleotide
gagtgagcc

SEQ ID NO: 5222 - DNA, 9 bp, Artificial Sequence
  Synthetic oligonucleotide
gagtgtgaa

SEQ ID NO: 5223 - DNA, 9 bp, Artificial Sequence
  Synthetic oligonucleotide
gagtgaagt

SEQ ID NO: 5224 - DNA, 9 bp, Artificial Sequence
  Synthetic oligonucleotide
gagggaggc

SEQ ID NO: 5225 - DNA, 9 bp, Artificial Sequence
  Synthetic oligonucleotide
gagtgtggc

SEQ ID NO: 5226 - DNA, 9 bp, Artificial Sequence
  Synthetic oligonucleotide
gagtggtga

SEQ ID NO: 5227 - DNA, 9 bp, Artificial Sequence
  Synthetic oligonucleotide
gtgtgaggc

SEQ ID NO: 5228 - DNA, 9 bp, Artificial Sequence
  Synthetic oligonucleotide
aagtgaggg

SEQ ID NO: 5229 - DNA, 9 bp, Artificial Sequence
  Synthetic oligonucleotide
gagtgagtg

SEQ ID NO: 5230 - DNA, 9 bp, Artificial Sequence
  Synthetic oligonucleotide
aagtgaggg

SEQ ID NO: 5231 - DNA, 9 bp, Artificial Sequence
  Synthetic oligonucleotide
cagtgaggg

SEQ ID NO: 5232 - DNA, 9 bp, Artificial Sequence
  Synthetic oligonucleotide
gagtgagtt

SEQ ID NO: 5233 - DNA, 9 bp, Artificial Sequence
  Synthetic oligonucleotide
gagtgagat

SEQ ID NO: 5234 - DNA, 9 bp, Artificial Sequence
  Synthetic oligonucleotide
gagtgagag

SEQ ID NO: 5235 - DNA, 9 bp, Artificial Sequence
  Synthetic oligonucleotide
cagtgaggc

SEQ ID NO: 5236 - DNA, 9 bp, Artificial Sequence
  Synthetic oligonucleotide
gagggaggt

SEQ ID NO: 5237 - DNA, 9 bp, Artificial Sequence
  Synthetic oligonucleotide
gagtgagtg

SEQ ID NO: 5238 - DNA, 9 bp, Artificial Sequence
  Synthetic oligonucleotide
gagtgtggg

SEQ ID NO: 5239 - DNA, 9 bp, Artificial Sequence
  Synthetic oligonucleotide
cagtgaggg

SEQ ID NO: 5240 - DNA, 9 bp, Artificial Sequence
  Synthetic oligonucleotide
gagtgagac

SEQ ID NO: 5241 - DNA, 9 bp, Artificial Sequence
  Synthetic oligonucleotide
gagtgtggc

SEQ ID NO: 5242 - DNA, 9 bp, Artificial Sequence
  Synthetic oligonucleotide
cagtgaggc

SEQ ID NO: 5243 - DNA, 9 bp, Artificial Sequence
  Synthetic oligonucleotide
gagagaggc

SEQ ID NO: 5244 - DNA, 9 bp, Artificial Sequence
  Synthetic oligonucleotide
gagagggga

SEQ ID NO: 5245 - DNA, 9 bp, Artificial Sequence
  Synthetic oligonucleotide
gagtgagtg

SEQ ID NO: 5246 - DNA, 9 bp, Artificial Sequence
  Synthetic oligonucleotide
cagtgagca

SEQ ID NO: 5247 - DNA, 9 bp, Artificial Sequence
  Synthetic oligonucleotide
cagtgaggg

SEQ ID NO: 5248 - DNA, 9 bp, Artificial Sequence
  Synthetic oligonucleotide
cagtgaggg

SEQ ID NO: 5249 - DNA, 9 bp, Artificial Sequence
  Synthetic oligonucleotide
tagtgagta

SEQ ID NO: 5250 - DNA, 9 bp, Artificial Sequence
  Synthetic oligonucleotide
gagtgagtg

SEQ ID NO: 5251 - DNA, 9 bp, Artificial Sequence
  Synthetic oligonucleotide
aagtgaggg

SEQ ID NO: 5252 - DNA, 9 bp, Artificial Sequence
  Synthetic oligonucleotide
gagagaggc

SEQ ID NO: 5253 - DNA, 9 bp, Artificial Sequence
  Synthetic oligonucleotide
gtgtgaggc

SEQ ID NO: 5254 - DNA, 9 bp, Artificial Sequence
  Synthetic oligonucleotide
gagggaggc

SEQ ID NO: 5255 - DNA, 9 bp, Artificial Sequence
  Synthetic oligonucleotide
gagtgatgt

SEQ ID NO: 5256 - DNA, 9 bp, Artificial Sequence
  Synthetic oligonucleotide
gagcgaggc

SEQ ID NO: 5257 - DNA, 9 bp, Artificial Sequence
  Synthetic oligonucleotide
gagtgtggg

SEQ ID NO: 5258 - DNA, 9 bp, Artificial Sequence
  Synthetic oligonucleotide
gagtgagtg

SEQ ID NO: 5259 - DNA, 9 bp, Artificial Sequence
  Synthetic oligonucleotide
gagtaaggt

SEQ ID NO: 5260 - DNA, 9 bp, Artificial Sequence
  Synthetic oligonucleotide
tagtgaggg

SEQ ID NO: 5261 - DNA, 9 bp, Artificial Sequence
  Synthetic oligonucleotide
cagtgaggg

SEQ ID NO: 5262 - DNA, 9 bp, Artificial Sequence
  Synthetic oligonucleotide
gagtgagat

SEQ ID NO: 5263 - DNA, 9 bp, Artificial Sequence
  Synthetic oligonucleotide
gagtgagat

SEQ ID NO: 5264 - DNA, 9 bp, Artificial Sequence
  Synthetic oligonucleotide
aagtgtgga

SEQ ID NO: 5265 - DNA, 9 bp, Artificial Sequence
  Synthetic oligonucleotide
gagggaggt

SEQ ID NO: 5266 - DNA, 9 bp, Artificial Sequence
  Synthetic oligonucleotide
cagggagga

SEQ ID NO: 5267 - DNA, 9 bp, Artificial Sequence
  Synthetic oligonucleotide
aagtgaggc

SEQ ID NO: 5268 - DNA, 9 bp, Artificial Sequence
  Synthetic oligonucleotide
aagtgaggc

SEQ ID NO: 5269 - DNA, 9 bp, Artificial Sequence
  Synthetic oligonucleotide
aagtgaggc

SEQ ID NO: 5270 - DNA, 9 bp, Artificial Sequence
  Synthetic oligonucleotide
gtgtgaggc

SEQ ID NO: 5271 - DNA, 9 bp, Artificial Sequence
  Synthetic oligonucleotide
aagtgaggg

SEQ ID NO: 5272 - DNA, 9 bp, Artificial Sequence
  Synthetic oligonucleotide
cagtgaggt

SEQ ID NO: 5273 - DNA, 9 bp, Artificial Sequence
  Synthetic oligonucleotide
gagtgagag

SEQ ID NO: 5274 - DNA, 9 bp, Artificial Sequence
  Synthetic oligonucleotide
gagtaaggc

SEQ ID NO: 5275 - DNA, 9 bp, Artificial Sequence
  Synthetic oligonucleotide
aagtgaggt

SEQ ID NO: 5276 - DNA, 9 bp, Artificial Sequence
  Synthetic oligonucleotide
gagacagga

SEQ ID NO: 5277 - DNA, 9 bp, Artificial Sequence
  Synthetic oligonucleotide
cagtgaggg

SEQ ID NO: 5278 - DNA, 9 bp, Artificial Sequence
  Synthetic oligonucleotide
tagtgaggc

SEQ ID NO: 5279 - DNA, 9 bp, Artificial Sequence
  Synthetic oligonucleotide
gggtgaggg

SEQ ID NO: 5280 - DNA, 9 bp, Artificial Sequence
  Synthetic oligonucleotide
gagtgagat

SEQ ID NO: 5281 - DNA, 9 bp, Artificial Sequence
  Synthetic oligonucleotide
gagggaggc

SEQ ID NO: 5282 - DNA, 9 bp, Artificial Sequence
  Synthetic oligonucleotide
gagagggga

SEQ ID NO: 5283 - DNA, 9 bp, Artificial Sequence
  Synthetic oligonucleotide
gagtgagct

SEQ ID NO: 5284 - DNA, 9 bp, Artificial Sequence
  Synthetic oligonucleotide
gagtgagag

SEQ ID NO: 5285 - DNA, 9 bp, Artificial Sequence
  Synthetic oligonucleotide
gagtgagat

SEQ ID NO: 5286 - DNA, 9 bp, Artificial Sequence
  Synthetic oligonucleotide
gagtgtggc

SEQ ID NO: 5287 - DNA, 9 bp, Artificial Sequence
  Synthetic oligonucleotide
tagtgaggc

SEQ ID NO: 5288 - DNA, 9 bp, Artificial Sequence
  Synthetic oligonucleotide
aaatgagga

SEQ ID NO: 5289 - DNA, 9 bp, Artificial Sequence
  Synthetic oligonucleotide
gagagaggt

SEQ ID NO: 5290 - DNA, 9 bp, Artificial Sequence
  Synthetic oligonucleotide
aagtgagta

SEQ ID NO: 5291 - DNA, 9 bp, Artificial Sequence
  Synthetic oligonucleotide
gagggaggt

SEQ ID NO: 5292 - DNA, 9 bp, Artificial Sequence
  Synthetic oligonucleotide
tagtgaggg

SEQ ID NO: 5293 - DNA, 9 bp, Artificial Sequence
  Synthetic oligonucleotide
gtgtgaggc

SEQ ID NO: 5294 - DNA, 9 bp, Artificial Sequence
  Synthetic oligonucleotide
gagtgagtt

SEQ ID NO: 5295 - DNA, 9 bp, Artificial Sequence
  Synthetic oligonucleotide
cagtgaggg

SEQ ID NO: 5296 - DNA, 9 bp, Artificial Sequence
  Synthetic oligonucleotide
gagtgagtc

SEQ ID NO: 5297 - DNA, 9 bp, Artificial Sequence
  Synthetic oligonucleotide
gagagaggc

SEQ ID NO: 5298 - DNA, 9 bp, Artificial Sequence
  Synthetic oligonucleotide
gggtgaggc

SEQ ID NO: 5299 - DNA, 9 bp, Artificial Sequence
  Synthetic oligonucleotide
gtgtgaggg

SEQ ID NO: 5300 - DNA, 9 bp, Artificial Sequence
  Synthetic oligonucleotide
gtgtgaggc

SEQ ID NO: 5301 - DNA, 9 bp, Artificial Sequence
  Synthetic oligonucleotide
gagtgtggt

SEQ ID NO: 5302 - DNA, 9 bp, Artificial Sequence
  Synthetic oligonucleotide
gagtgtgta

SEQ ID NO: 5303 - DNA, 9 bp, Artificial Sequence
  Synthetic oligonucleotide
gagggaggt

SEQ ID NO: 5304 - DNA, 9 bp, Artificial Sequence
  Synthetic oligonucleotide
gagggaggg

SEQ ID NO: 5305 - DNA, 9 bp, Artificial Sequence
  Synthetic oligonucleotide
gagtggggc

SEQ ID NO: 5306 - DNA, 9 bp, Artificial Sequence
  Synthetic oligonucleotide
gagtgagag

SEQ ID NO: 5307 - DNA, 9 bp, Artificial Sequence
  Synthetic oligonucleotide
gagtgagcg

SEQ ID NO: 5308 - DNA, 9 bp, Artificial Sequence
  Synthetic oligonucleotide
cagtgaggc

SEQ ID NO: 5309 - DNA, 9 bp, Artificial Sequence
  Synthetic oligonucleotide
gagtgagat

SEQ ID NO: 5310 - DNA, 9 bp, Artificial Sequence
  Synthetic oligonucleotide
gagggagaa

SEQ ID NO: 5311 - DNA, 9 bp, Artificial Sequence
  Synthetic oligonucleotide
gagtgtgta

SEQ ID NO: 5312 - DNA, 9 bp, Artificial Sequence
  Synthetic oligonucleotide
gagggaggg

SEQ ID NO: 5313 - DNA, 9 bp, Artificial Sequence
  Synthetic oligonucleotide
gagtgagtt

SEQ ID NO: 5314 - DNA, 9 bp, Artificial Sequence
  Synthetic oligonucleotide
gggtgagaa

SEQ ID NO: 5315 - DNA, 9 bp, Artificial Sequence
  Synthetic oligonucleotide
gagggaggc

SEQ ID NO: 5316 - DNA, 9 bp, Artificial Sequence
  Synthetic oligonucleotide
gagagaggt

SEQ ID NO: 5317 - DNA, 9 bp, Artificial Sequence
  Synthetic oligonucleotide
gagggaggt

SEQ ID NO: 5318 - DNA, 9 bp, Artificial Sequence
  Synthetic oligonucleotide
aagtgaggc

SEQ ID NO: 5319 - DNA, 9 bp, Artificial Sequence
  Synthetic oligonucleotide
gagtgagtg

SEQ ID NO: 5320 - DNA, 9 bp, Artificial Sequence
  Synthetic oligonucleotide
gagtgagac

SEQ ID NO: 5321 - DNA, 9 bp, Artificial Sequence
  Synthetic oligonucleotide
gagtaaggt

SEQ ID NO: 5322 - DNA, 9 bp, Artificial Sequence
  Synthetic oligonucleotide
aagtgaggc

SEQ ID NO: 5323 - DNA, 9 bp, Artificial Sequence
  Synthetic oligonucleotide
gagagaggc

SEQ ID NO: 5324 - DNA, 9 bp, Artificial Sequence
  Synthetic oligonucleotide
gtgtgaggg

SEQ ID NO: 5325 - DNA, 9 bp, Artificial Sequence
  Synthetic oligonucleotide
cagtgaggt

SEQ ID NO: 5326 - DNA, 9 bp, Artificial Sequence
  Synthetic oligonucleotide
gggtgaggt

SEQ ID NO: 5327 - DNA, 9 bp, Artificial Sequence
  Synthetic oligonucleotide
gagggaggt

SEQ ID NO: 5328 - DNA, 9 bp, Artificial Sequence
  Synthetic oligonucleotide
gaatgagca

SEQ ID NO: 5329 - DNA, 9 bp, Artificial Sequence
  Synthetic oligonucleotide
gattgaggg

SEQ ID NO: 5330 - DNA, 9 bp, Artificial Sequence
  Synthetic oligonucleotide
gagggaggc

SEQ ID NO: 5331 - DNA, 9 bp, Artificial Sequence
  Synthetic oligonucleotide
aagtgaggg

SEQ ID NO: 5332 - DNA, 9 bp, Artificial Sequence
  Synthetic oligonucleotide
gagtatgga

SEQ ID NO: 5333 - DNA, 9 bp, Artificial Sequence
  Synthetic oligonucleotide
cagtgaggt

SEQ ID NO: 5334 - DNA, 9 bp, Artificial Sequence
  Synthetic oligonucleotide
tagtgaggc

SEQ ID NO: 5335 - DNA, 9 bp, Artificial Sequence
  Synthetic oligonucleotide
gtgtgaggc

SEQ ID NO: 5336 - DNA, 9 bp, Artificial Sequence
  Synthetic oligonucleotide
gtgtgaggt

SEQ ID NO: 5337 - DNA, 9 bp, Artificial Sequence
  Synthetic oligonucleotide
gtgtgaggc

SEQ ID NO: 5338 - DNA, 9 bp, Artificial Sequence
  Synthetic oligonucleotide
aggtgagga

SEQ ID NO: 5339 - DNA, 9 bp, Artificial Sequence
  Synthetic oligonucleotide
gagcgaggt

SEQ ID NO: 5340 - DNA, 9 bp, Artificial Sequence
  Synthetic oligonucleotide
gggtgaggc

SEQ ID NO: 5341 - DNA, 9 bp, Artificial Sequence
  Synthetic oligonucleotide
tagtgaggc

SEQ ID NO: 5342 - DNA, 9 bp, Artificial Sequence
  Synthetic oligonucleotide
gcgtgtgga

SEQ ID NO: 5343 - DNA, 9 bp, Artificial Sequence
  Synthetic oligonucleotide
gagtgagat

SEQ ID NO: 5344 - DNA, 9 bp, Artificial Sequence
  Synthetic oligonucleotide
gagtgagat

SEQ ID NO: 5345 - DNA, 9 bp, Artificial Sequence
  Synthetic oligonucleotide
cagtgaggc

SEQ ID NO: 5346 - DNA, 9 bp, Artificial Sequence
  Synthetic oligonucleotide
gtgtgaggg

SEQ ID NO: 5347 - DNA, 9 bp, Artificial Sequence
  Synthetic oligonucleotide
aagtgaggc

SEQ ID NO: 5348 - DNA, 9 bp, Artificial Sequence
  Synthetic oligonucleotide
gtgtgaggg

SEQ ID NO: 5349 - DNA, 9 bp, Artificial Sequence
  Synthetic oligonucleotide
tagtgaggc

SEQ ID NO: 5350 - DNA, 9 bp, Artificial Sequence
  Synthetic oligonucleotide
gagtgagat

SEQ ID NO: 5351 - DNA, 9 bp, Artificial Sequence
  Synthetic oligonucleotide
gagggaggc

SEQ ID NO: 5352 - DNA, 9 bp, Artificial Sequence
  Synthetic oligonucleotide
gagtaaggg

SEQ ID NO: 5353 - DNA, 9 bp, Artificial Sequence
  Synthetic oligonucleotide
cagtgaggg

SEQ ID NO: 5354 - DNA, 9 bp, Artificial Sequence
  Synthetic oligonucleotide
cagtgaggg

SEQ ID NO: 5355 - DNA, 9 bp, Artificial Sequence
  Synthetic oligonucleotide
gagtgcaga

SEQ ID NO: 5356 - DNA, 9 bp, Artificial Sequence
  Synthetic oligonucleotide
gagtgtgaa

SEQ ID NO: 5357 - DNA, 9 bp, Artificial Sequence
  Synthetic oligonucleotide
gagtgagat

SEQ ID NO: 5358 - DNA, 9 bp, Artificial Sequence
  Synthetic oligonucleotide
gggtgaggg

SEQ ID NO: 5359 - DNA, 9 bp, Artificial Sequence
  Synthetic oligonucleotide
gagtgtgaa

SEQ ID NO: 5360 - DNA, 9 bp, Artificial Sequence
  Synthetic oligonucleotide
gagtgagtg

SEQ ID NO: 5361 - DNA, 9 bp, Artificial Sequence
  Synthetic oligonucleotide
gagggaggg

SEQ ID NO: 5362 - DNA, 9 bp, Artificial Sequence
  Synthetic oligonucleotide
gagggagaa

SEQ ID NO: 5363 - DNA, 9 bp, Artificial Sequence
  Synthetic oligonucleotide
gagtgagcc

SEQ ID NO: 5364 - DNA, 9 bp, Artificial Sequence
  Synthetic oligonucleotide
gagtgtggt

SEQ ID NO: 5365 - DNA, 9 bp, Artificial Sequence
  Synthetic oligonucleotide
gagggaggc

SEQ ID NO: 5366 - DNA, 9 bp, Artificial Sequence
  Synthetic oligonucleotide
gagttaggg

SEQ ID NO: 5367 - DNA, 9 bp, Artificial Sequence
  Synthetic oligonucleotide
gagagaggc

SEQ ID NO: 5368 - DNA, 9 bp, Artificial Sequence
  Synthetic oligonucleotide
gagagaggt

SEQ ID NO: 5369 - DNA, 9 bp, Artificial Sequence
  Synthetic oligonucleotide
gggtgaggc

SEQ ID NO: 5370 - DNA, 9 bp, Artificial Sequence
  Synthetic oligonucleotide
gagtgagtc

SEQ ID NO: 5371 - DNA, 9 bp, Artificial Sequence
  Synthetic oligonucleotide
aagtgaggg

SEQ ID NO: 5372 - DNA, 9 bp, Artificial Sequence
  Synthetic oligonucleotide
gagagaggc

SEQ ID NO: 5373 - DNA, 9 bp, Artificial Sequence
  Synthetic oligonucleotide
cagtgaggt

SEQ ID NO: 5374 - DNA, 9 bp, Artificial Sequence
  Synthetic oligonucleotide
cagtgaggc

SEQ ID NO: 5375 - DNA, 9 bp, Artificial Sequence
  Synthetic oligonucleotide
cagtgaggg

SEQ ID NO: 5376 - DNA, 9 bp, Artificial Sequence
  Synthetic oligonucleotide
gagtgagtt

SEQ ID NO: 5377 - DNA, 9 bp, Artificial Sequence
  Synthetic oligonucleotide
cagtgaggt

SEQ ID NO: 5378 - DNA, 9 bp, Artificial Sequence
  Synthetic oligonucleotide
gagtgagcc

SEQ ID NO: 5379 - DNA, 9 bp, Artificial Sequence
  Synthetic oligonucleotide
gtgtgaggt

SEQ ID NO: 5380 - DNA, 9 bp, Artificial Sequence
  Synthetic oligonucleotide
gagtgagat

SEQ ID NO: 5381 - DNA, 9 bp, Artificial Sequence
  Synthetic oligonucleotide
gagggaggc

SEQ ID NO: 5382 - DNA, 9 bp, Artificial Sequence
  Synthetic oligonucleotide
aagtgaggg

SEQ ID NO: 5383 - DNA, 9 bp, Artificial Sequence
  Synthetic oligonucleotide
gagggaggc

SEQ ID NO: 5384 - DNA, 9 bp, Artificial Sequence
  Synthetic oligonucleotide
gagggaggg

SEQ ID NO: 5385 - DNA, 9 bp, Artificial Sequence
  Synthetic oligonucleotide
gagtgagag

SEQ ID NO: 5386 - DNA, 9 bp, Artificial Sequence
  Synthetic oligonucleotide
gagggaggt

SEQ ID NO: 5387 - DNA, 9 bp, Artificial Sequence
  Synthetic oligonucleotide
tagtgaggg

SEQ ID NO: 5388 - DNA, 9 bp, Artificial Sequence
  Synthetic oligonucleotide
gagtgaggc

SEQ ID NO: 5389 - DNA, 9 bp, Artificial Sequence
  Synthetic oligonucleotide
gagtgaggt

SEQ ID NO: 5390 - DNA, 9 bp, Artificial Sequence
  Synthetic oligonucleotide
gtgtgagga

SEQ ID NO: 5391 - DNA, 9 bp, Artificial Sequence
  Synthetic oligonucleotide
gagtgaggg

SEQ ID NO: 5392 - DNA, 9 bp, Artificial Sequence
  Synthetic oligonucleotide
gagggagga

SEQ ID NO: 5393 - DNA, 9 bp, Artificial Sequence
  Synthetic oligonucleotide
gagtgaggt

SEQ ID NO: 5394 - DNA, 9 bp, Artificial Sequence
  Synthetic oligonucleotide
gagtgaggt

SEQ ID NO: 5395 - DNA, 9 bp, Artificial Sequence
  Synthetic oligonucleotide
gagtgaggc

SEQ ID NO: 5396 - DNA, 9 bp, Artificial Sequence
  Synthetic oligonucleotide
gagtgaggg

SEQ ID NO: 5397 - DNA, 9 bp, Artificial Sequence
  Synthetic oligonucleotide
gtgtgagga

SEQ ID NO: 5398 - DNA, 9 bp, Artificial Sequence
  Synthetic oligonucleotide
gagggagga

SEQ ID NO: 5399 - DNA, 9 bp, Artificial Sequence
  Synthetic oligonucleotide
aagtgagga

SEQ ID NO: 5400 - DNA, 9 bp, Artificial Sequence
  Synthetic oligonucleotide
gagtgaggg

SEQ ID NO: 5401 - DNA, 9 bp, Artificial Sequence
  Synthetic oligonucleotide
gagtaagga

SEQ ID NO: 5402 - DNA, 9 bp, Artificial Sequence
  Synthetic oligonucleotide
gagtgaggt

SEQ ID NO: 5403 - DNA, 9 bp, Artificial Sequence
  Synthetic oligonucleotide
gagtgaggg

SEQ ID NO: 5404 - DNA, 9 bp, Artificial Sequence
  Synthetic oligonucleotide
gagtgaggg

SEQ ID NO: 5405 - DNA, 9 bp, Artificial Sequence
  Synthetic oligonucleotide
gagtgaggc

SEQ ID NO: 5406 - DNA, 9 bp, Artificial Sequence
  Synthetic oligonucleotide
gagtgaggc

SEQ ID NO: 5407 - DNA, 9 bp, Artificial Sequence
  Synthetic oligonucleotide
gagtgggga

SEQ ID NO: 5408 - DNA, 9 bp, Artificial Sequence
  Synthetic oligonucleotide
gagtgaggg

SEQ ID NO: 5409 - DNA, 9 bp, Artificial Sequence
  Synthetic oligonucleotide
gagtgaggt

SEQ ID NO: 5410 - DNA, 9 bp, Artificial Sequence
  Synthetic oligonucleotide
gagtgaggt

SEQ ID NO: 5411 - DNA, 9 bp, Artificial Sequence
  Synthetic oligonucleotide
gggtgagga

SEQ ID NO: 5412 - DNA, 9 bp, Artificial Sequence
  Synthetic oligonucleotide
gggtgagga

SEQ ID NO: 5413 - DNA, 9 bp, Artificial Sequence
  Synthetic oligonucleotide
gagtgaggc

SEQ ID NO: 5414 - DNA, 9 bp, Artificial Sequence
  Synthetic oligonucleotide
gagtgaggt

SEQ ID NO: 5415 - DNA, 9 bp, Artificial Sequence
  Synthetic oligonucleotide
gagtgaggt

SEQ ID NO: 5416 - DNA, 9 bp, Artificial Sequence
  Synthetic oligonucleotide
gagtgaggg

SEQ ID NO: 5417 - DNA, 9 bp, Artificial Sequence
  Synthetic oligonucleotide
gagtgaggc

SEQ ID NO: 5418 - DNA, 9 bp, Artificial Sequence
  Synthetic oligonucleotide
gagtgaggt

SEQ ID NO: 5419 - DNA, 9 bp, Artificial Sequence
  Synthetic oligonucleotide
gagtgaggg

SEQ ID NO: 5420 - DNA, 9 bp, Artificial Sequence
  Synthetic oligonucleotide
gagtgaggc

SEQ ID NO: 5421 - DNA, 9 bp, Artificial Sequence
  Synthetic oligonucleotide
gggtgagga

SEQ ID NO: 5422 - DNA, 9 bp, Artificial Sequence
  Synthetic oligonucleotide
gagtgaggg

SEQ ID NO: 5423 - DNA, 9 bp, Artificial Sequence
  Synthetic oligonucleotide
gagtgaggt

SEQ ID NO: 5424 - DNA, 9 bp, Artificial Sequence
  Synthetic oligonucleotide
gagtgaggc

SEQ ID NO: 5425 - DNA, 9 bp, Artificial Sequence
  Synthetic oligonucleotide
gagtgaggc

SEQ ID NO: 5426 - DNA, 9 bp, Artificial Sequence
  Synthetic oligonucleotide
gagtgaggc

SEQ ID NO: 5427 - DNA, 9 bp, Artificial Sequence
  Synthetic oligonucleotide
gagtgaggt

SEQ ID NO: 5428 - DNA, 9 bp, Artificial Sequence
  Synthetic oligonucleotide
gagtgaggc

SEQ ID NO: 5429 - DNA, 9 bp, Artificial Sequence
  Synthetic oligonucleotide
gagtgaggg

SEQ ID NO: 5430 - DNA, 9 bp, Artificial Sequence
  Synthetic oligonucleotide
gagtgaggg

SEQ ID NO: 5431 - DNA, 9 bp, Artificial Sequence
  Synthetic oligonucleotide
gagtgaggc

SEQ ID NO: 5432 - DNA, 9 bp, Artificial Sequence
  Synthetic oligonucleotide
gagggagga

SEQ ID NO: 5433 - DNA, 9 bp, Artificial Sequence
  Synthetic oligonucleotide
gagtgaggc

SEQ ID NO: 5434 - DNA, 9 bp, Artificial Sequence
  Synthetic oligonucleotide
gagtgaggg

SEQ ID NO: 5435 - DNA, 9 bp, Artificial Sequence
  Synthetic oligonucleotide
gagtgaggc

SEQ ID NO: 5436 - DNA, 9 bp, Artificial Sequence
  Synthetic oligonucleotide
gagtgaggg

SEQ ID NO: 5437 - DNA, 9 bp, Artificial Sequence
  Synthetic oligonucleotide
gagtgaggt

SEQ ID NO: 5438 - DNA, 9 bp, Artificial Sequence
  Synthetic oligonucleotide
gagtgaggc

SEQ ID NO: 5439 - DNA, 9 bp, Artificial Sequence
  Synthetic oligonucleotide
gagtgagaa

SEQ ID NO: 5440 - DNA, 9 bp, Artificial Sequence
  Synthetic oligonucleotide
gagtgaggc

SEQ ID NO: 5441 - DNA, 9 bp, Artificial Sequence
  Synthetic oligonucleotide
gagtgaggc

SEQ ID NO: 5442 - DNA, 9 bp, Artificial Sequence
  Synthetic oligonucleotide
gtgtgagga

SEQ ID NO: 5443 - DNA, 9 bp, Artificial Sequence
  Synthetic oligonucleotide
gagtgaggg

SEQ ID NO: 5444 - DNA, 9 bp, Artificial Sequence
  Synthetic oligonucleotide
gagagagga

SEQ ID NO: 5445 - DNA, 9 bp, Artificial Sequence
  Synthetic oligonucleotide
gggtgagga

SEQ ID NO: 5446 - DNA, 9 bp, Artificial Sequence
  Synthetic oligonucleotide
gagtgaggc

SEQ ID NO: 5447 - DNA, 9 bp, Artificial Sequence
  Synthetic oligonucleotide
gagtgaggt

SEQ ID NO: 5448 - DNA, 9 bp, Artificial Sequence
  Synthetic oligonucleotide
gagtgaggg

SEQ ID NO: 5449 - DNA, 9 bp, Artificial Sequence
  Synthetic oligonucleotide
gagtgaggc

SEQ ID NO: 5450 - DNA, 9 bp, Artificial Sequence
  Synthetic oligonucleotide
aagtgagga

SEQ ID NO: 5451 - DNA, 9 bp, Artificial Sequence
  Synthetic oligonucleotide
gagtgaggt

SEQ ID NO: 5452 - DNA, 9 bp, Artificial Sequence
  Synthetic oligonucleotide
gagtgaggg

SEQ ID NO: 5453 - DNA, 9 bp, Artificial Sequence
  Synthetic oligonucleotide
gggtgagga

SEQ ID NO: 5454 - DNA, 9 bp, Artificial Sequence
  Synthetic oligonucleotide
tagtgagga

SEQ ID NO: 5455 - DNA, 9 bp, Artificial Sequence
  Synthetic oligonucleotide
gggtgagga

SEQ ID NO: 5456 - DNA, 9 bp, Artificial Sequence
  Synthetic oligonucleotide
gagtgaggc

SEQ ID NO: 5457 - DNA, 9 bp, Artificial Sequence
  Synthetic oligonucleotide
gagtgaggc

SEQ ID NO: 5458 - DNA, 9 bp, Artificial Sequence
  Synthetic oligonucleotide
gagtgaggt

SEQ ID NO: 5459 - DNA, 9 bp, Artificial Sequence
  Synthetic oligonucleotide
gagtgaggc

SEQ ID NO: 5460 - DNA, 9 bp, Artificial Sequence
  Synthetic oligonucleotide
gagtgaggc

SEQ ID NO: 5461 - DNA, 9 bp, Artificial Sequence
  Synthetic oligonucleotide
aagtgagga

SEQ ID NO: 5462 - DNA, 9 bp, Artificial Sequence
  Synthetic oligonucleotide
gagtgaggc

SEQ ID NO: 5463 - DNA, 9 bp, Artificial Sequence
  Synthetic oligonucleotide
gagtaagga

SEQ ID NO: 5464 - DNA, 9 bp, Artificial Sequence
  Synthetic oligonucleotide
gagtgaggt

SEQ ID NO: 5465 - DNA, 9 bp, Artificial Sequence
  Synthetic oligonucleotide
gagtgaggt

SEQ ID NO: 5466 - DNA, 9 bp, Artificial Sequence
  Synthetic oligonucleotide
gagtgagta

SEQ ID NO: 5467 - DNA, 9 bp, Artificial Sequence
  Synthetic oligonucleotide
gagtgaggg

SEQ ID NO: 5468 - DNA, 9 bp, Artificial Sequence
  Synthetic oligonucleotide
gagtgaggg

SEQ ID NO: 5469 - DNA, 9 bp, Artificial Sequence
  Synthetic oligonucleotide
gagtgaggt

SEQ ID NO: 5470 - DNA, 9 bp, Artificial Sequence
  Synthetic oligonucleotide
gagtgaggt

SEQ ID NO: 5471 - DNA, 9 bp, Artificial Sequence
  Synthetic oligonucleotide
gagtgaggg

SEQ ID NO: 5472 - DNA, 9 bp, Artificial Sequence
  Synthetic oligonucleotide
gagtgaggc

SEQ ID NO: 5473 - DNA, 9 bp, Artificial Sequence
  Synthetic oligonucleotide
gagtgaggt

SEQ ID NO: 5474 - DNA, 9 bp, Artificial Sequence
  Synthetic oligonucleotide
gagtgaggg

SEQ ID NO: 5475 - DNA, 9 bp, Artificial Sequence
  Synthetic oligonucleotide
gagtgaggg

SEQ ID NO: 5476 - DNA, 9 bp, Artificial Sequence
  Synthetic oligonucleotide
gagtgaggt

SEQ ID NO: 5477 - DNA, 9 bp, Artificial Sequence
  Synthetic oligonucleotide
gagtgaggg

SEQ ID NO: 5478 - DNA, 9 bp, Artificial Sequence
  Synthetic oligonucleotide
gagtgaggg

SEQ ID NO: 5479 - DNA, 9 bp, Artificial Sequence
  Synthetic oligonucleotide
gagtgaggt

SEQ ID NO: 5480 - DNA, 9 bp, Artificial Sequence
  Synthetic oligonucleotide
gagtgaggc

SEQ ID NO: 5481 - DNA, 9 bp, Artificial Sequence
  Synthetic oligonucleotide
gagtgaggc

SEQ ID NO: 5482 - DNA, 9 bp, Artificial Sequence
  Synthetic oligonucleotide
gagtgaggc

SEQ ID NO: 5483 - DNA, 9 bp, Artificial Sequence
  Synthetic oligonucleotide
gagtgaggg

SEQ ID NO: 5484 - DNA, 9 bp, Artificial Sequence
  Synthetic oligonucleotide
gagtgaggt

SEQ ID NO: 5485 - DNA, 9 bp, Artificial Sequence
  Synthetic oligonucleotide
gagtgaggc

SEQ ID NO: 5486 - DNA, 9 bp, Artificial Sequence
  Synthetic oligonucleotide
gagtgaggg

SEQ ID NO: 5487 - DNA, 9 bp, Artificial Sequence
  Synthetic oligonucleotide
tagtgagga

SEQ ID NO: 5488 - DNA, 9 bp, Artificial Sequence
  Synthetic oligonucleotide
gagtgaggt

SEQ ID NO: 5489 - DNA, 9 bp, Artificial Sequence
  Synthetic oligonucleotide
gagtgagta

SEQ ID NO: 5490 - DNA, 9 bp, Artificial Sequence
  Synthetic oligonucleotide
gagtgaggt

SEQ ID NO: 5491 - DNA, 9 bp, Artificial Sequence
  Synthetic oligonucleotide
gagtgaggg

SEQ ID NO: 5492 - DNA, 9 bp, Artificial Sequence
  Synthetic oligonucleotide
gagtgaggc

SEQ ID NO: 5493 - DNA, 9 bp, Artificial Sequence
  Synthetic oligonucleotide
gagtgaggc

SEQ ID NO: 5494 - DNA, 9 bp, Artificial Sequence
  Synthetic oligonucleotide
gagtgaggt

SEQ ID NO: 5495 - DNA, 9 bp, Artificial Sequence
  Synthetic oligonucleotide
gagtgaggt

SEQ ID NO: 5496 - DNA, 9 bp, Artificial Sequence
  Synthetic oligonucleotide
gagtgaggg

SEQ ID NO: 5497 - DNA, 9 bp, Artificial Sequence
  Synthetic oligonucleotide
gagtgaggg

SEQ ID NO: 5498 - DNA, 9 bp, Artificial Sequence
  Synthetic oligonucleotide
gagtgaggg

SEQ ID NO: 5499 - DNA, 9 bp, Artificial Sequence
  Synthetic oligonucleotide
gagtgaggt

SEQ ID NO: 5500 - DNA, 9 bp, Artificial Sequence
  Synthetic oligonucleotide
gagtgaggc

SEQ ID NO: 5501 - DNA, 9 bp, Artificial Sequence
  Synthetic oligonucleotide
gagtgaggc

SEQ ID NO: 5502 - DNA, 9 bp, Artificial Sequence
  Synthetic oligonucleotide
gagtgaggt

SEQ ID NO: 5503 - DNA, 9 bp, Artificial Sequence
  Synthetic oligonucleotide
gagtgaggg

SEQ ID NO: 5504 - DNA, 9 bp, Artificial Sequence
  Synthetic oligonucleotide
gagtgaggg

SEQ ID NO: 5505 - DNA, 9 bp, Artificial Sequence
  Synthetic oligonucleotide
gagtgaggc

SEQ ID NO: 5506 - DNA, 9 bp, Artificial Sequence
  Synthetic oligonucleotide
gagtgaggt

SEQ ID NO: 5507 - DNA, 9 bp, Artificial Sequence
  Synthetic oligonucleotide
tagtgagga

SEQ ID NO: 5508 - DNA, 9 bp, Artificial Sequence
  Synthetic oligonucleotide
gagtgagta

SEQ ID NO: 5509 - DNA, 9 bp, Artificial Sequence
  Synthetic oligonucleotide
gtgtgagga

SEQ ID NO: 5510 - DNA, 9 bp, Artificial Sequence
  Synthetic oligonucleotide
gagtgaggg

SEQ ID NO: 5511 - DNA, 9 bp, Artificial Sequence
  Synthetic oligonucleotide
gagtgaggg

SEQ ID NO: 5512 - DNA, 9 bp, Artificial Sequence
  Synthetic oligonucleotide
gggtgagga

SEQ ID NO: 5513 - DNA, 9 bp, Artificial Sequence
  Synthetic oligonucleotide
gggtgagga

SEQ ID NO: 5514 - DNA, 9 bp, Artificial Sequence
  Synthetic oligonucleotide
gagtgagaa

SEQ ID NO: 5515 - DNA, 9 bp, Artificial Sequence
  Synthetic oligonucleotide
gagtgaggg

SEQ ID NO: 5516 - DNA, 9 bp, Artificial Sequence
  Synthetic oligonucleotide
gggtgagga

SEQ ID NO: 5517 - DNA, 9 bp, Artificial Sequence
  Synthetic oligonucleotide
gagtgaggg

SEQ ID NO: 5518 - DNA, 9 bp, Artificial Sequence
  Synthetic oligonucleotide
gtgtgagga

SEQ ID NO: 5519 - DNA, 9 bp, Artificial Sequence
  Synthetic oligonucleotide
gagtgagaa

SEQ ID NO: 5520 - DNA, 9 bp, Artificial Sequence
  Synthetic oligonucleotide
gagtgaggg

SEQ ID NO: 5521 - DNA, 9 bp, Artificial Sequence
  Synthetic oligonucleotide
gagtgaggg

SEQ ID NO: 5522 - DNA, 9 bp, Artificial Sequence
  Synthetic oligonucleotide
gagtgaggc

SEQ ID NO: 5523 - DNA, 9 bp, Artificial Sequence
  Synthetic oligonucleotide
gggtgagga

SEQ ID NO: 5524 - DNA, 9 bp, Artificial Sequence
  Synthetic oligonucleotide
gagtgaggt

SEQ ID NO: 5525 - DNA, 9 bp, Artificial Sequence
  Synthetic oligonucleotide
aagtgagga

SEQ ID NO: 5526 - DNA, 9 bp, Artificial Sequence
  Synthetic oligonucleotide
gagtgaggt

SEQ ID NO: 5527 - DNA, 9 bp, Artificial Sequence
  Synthetic oligonucleotide
gagggagga

SEQ ID NO: 5528 - DNA, 9 bp, Artificial Sequence
  Synthetic oligonucleotide
gagtgaggg

SEQ ID NO: 5529 - DNA, 9 bp, Artificial Sequence
  Synthetic oligonucleotide
gagtgaggg

SEQ ID NO: 5530 - DNA, 9 bp, Artificial Sequence
  Synthetic oligonucleotide
gagtgaggc

SEQ ID NO: 5531 - DNA, 9 bp, Artificial Sequence
  Synthetic oligonucleotide
gggtgagga

SEQ ID NO: 5532 - DNA, 9 bp, Artificial Sequence
  Synthetic oligonucleotide
gagtgaggt

SEQ ID NO: 5533 - DNA, 9 bp, Artificial Sequence
  Synthetic oligonucleotide
gagtgaggg

SEQ ID NO: 5534 - DNA, 9 bp, Artificial Sequence
  Synthetic oligonucleotide
gggtgagga

SEQ ID NO: 5535 - DNA, 9 bp, Artificial Sequence
  Synthetic oligonucleotide
gagtgaggc

SEQ ID NO: 5536 - DNA, 9 bp, Artificial Sequence
  Synthetic oligonucleotide
gagtgaggg

SEQ ID NO: 5537 - DNA, 9 bp, Artificial Sequence
  Synthetic oligonucleotide
gagtgaggc

SEQ ID NO: 5538 - DNA, 9 bp, Artificial Sequence
  Synthetic oligonucleotide
gagtgaggg

SEQ ID NO: 5539 - DNA, 9 bp, Artificial Sequence
  Synthetic oligonucleotide
gagtgaggc

SEQ ID NO: 5540 - DNA, 9 bp, Artificial Sequence
  Synthetic oligonucleotide
gagtgaggc

SEQ ID NO: 5541 - DNA, 9 bp, Artificial Sequence
  Synthetic oligonucleotide
gggtgagga

SEQ ID NO: 5542 - DNA, 9 bp, Artificial Sequence
  Synthetic oligonucleotide
gagtgaggc

SEQ ID NO: 5543 - DNA, 9 bp, Artificial Sequence
  Synthetic oligonucleotide
gagtgaggc

SEQ ID NO: 5544 - DNA, 9 bp, Artificial Sequence
  Synthetic oligonucleotide
gagtgaggc

SEQ ID NO: 5545 - DNA, 9 bp, Artificial Sequence
  Synthetic oligonucleotide
cagtgagga

SEQ ID NO: 5546 - DNA, 9 bp, Artificial Sequence
  Synthetic oligonucleotide
gagtgaggt

SEQ ID NO: 5547 - DNA, 9 bp, Artificial Sequence
  Synthetic oligonucleotide
aagtgagga

SEQ ID NO: 5548 - DNA, 9 bp, Artificial Sequence
  Synthetic oligonucleotide
tagtgagga

SEQ ID NO: 5549 - DNA, 9 bp, Artificial Sequence
  Synthetic oligonucleotide
gagtgagaa

SEQ ID NO: 5550 - DNA, 9 bp, Artificial Sequence
  Synthetic oligonucleotide
gagtgaggg

SEQ ID NO: 5551 - DNA, 9 bp, Artificial Sequence
  Synthetic oligonucleotide
gagtgaggg

SEQ ID NO: 5552 - DNA, 9 bp, Artificial Sequence
  Synthetic oligonucleotide
gagtgaggt

SEQ ID NO: 5553 - DNA, 9 bp, Artificial Sequence
  Synthetic oligonucleotide
gagggagga

SEQ ID NO: 5554 - DNA, 9 bp, Artificial Sequence
  Synthetic oligonucleotide
gagggagga

SEQ ID NO: 5555 - DNA, 9 bp, Artificial Sequence
  Synthetic oligonucleotide
aagtgagga

SEQ ID NO: 5556 - DNA, 9 bp, Artificial Sequence
  Synthetic oligonucleotide
gtgtgagga

SEQ ID NO: 5557 - DNA, 9 bp, Artificial Sequence
  Synthetic oligonucleotide
gagtgaggc

SEQ ID NO: 5558 - DNA, 9 bp, Artificial Sequence
  Synthetic oligonucleotide
gggtgagga

SEQ ID NO: 5559 - DNA, 9 bp, Artificial Sequence
  Synthetic oligonucleotide
gagtgaggt

SEQ ID NO: 5560 - DNA, 9 bp, Artificial Sequence
  Synthetic oligonucleotide
aagtgagga

SEQ ID NO: 5561 - DNA, 9 bp, Artificial Sequence
  Synthetic oligonucleotide
gagtgaggg

SEQ ID NO: 5562 - DNA, 9 bp, Artificial Sequence
  Synthetic oligonucleotide
gagtgaggg

SEQ ID NO: 5563 - DNA, 9 bp, Artificial Sequence
  Synthetic oligonucleotide
gtgtgagga

SEQ ID NO: 5564 - DNA, 9 bp, Artificial Sequence
  Synthetic oligonucleotide
gagtgaggg

SEQ ID NO: 5565 - DNA, 9 bp, Artificial Sequence
  Synthetic oligonucleotide
gagtgaggc

SEQ ID NO: 5566 - DNA, 9 bp, Artificial Sequence
  Synthetic oligonucleotide
gagtgaggg

SEQ ID NO: 5567 - DNA, 9 bp, Artificial Sequence
  Synthetic oligonucleotide
gagtgaggg

SEQ ID NO: 5568 - DNA, 9 bp, Artificial Sequence
  Synthetic oligonucleotide
gagtgaggc

SEQ ID NO: 5569 - DNA, 9 bp, Artificial Sequence
  Synthetic oligonucleotide
cagtgagga

SEQ ID NO: 5570 - DNA, 9 bp, Artificial Sequence
  Synthetic oligonucleotide
gagtgaggc

SEQ ID NO: 5571 - DNA, 9 bp, Artificial Sequence
  Synthetic oligonucleotide
gagtgaggt

SEQ ID NO: 5572 - DNA, 9 bp, Artificial Sequence
  Synthetic oligonucleotide
gagtgaggg

SEQ ID NO: 5573 - DNA, 9 bp, Artificial Sequence
  Synthetic oligonucleotide
gagtgaggc

SEQ ID NO: 5574 - DNA, 9 bp, Artificial Sequence
  Synthetic oligonucleotide
gagtgaggg

SEQ ID NO: 5575 - DNA, 9 bp, Artificial Sequence
  Synthetic oligonucleotide
gagtgaggt

SEQ ID NO: 5576 - DNA, 9 bp, Artificial Sequence
  Synthetic oligonucleotide
gagtgaggg

SEQ ID NO: 5577 - DNA, 9 bp, Artificial Sequence
  Synthetic oligonucleotide
gagtgaggc

SEQ ID NO: 5578 - DNA, 9 bp, Artificial Sequence
  Synthetic oligonucleotide
gagtgagaa

SEQ ID NO: 5579 - DNA, 9 bp, Artificial Sequence
  Synthetic oligonucleotide
gagtgagaa

SEQ ID NO: 5580 - DNA, 9 bp, Artificial Sequence
  Synthetic oligonucleotide
gagtgagaa

SEQ ID NO: 5581 - DNA, 9 bp, Artificial Sequence
  Synthetic oligonucleotide
gagtgagaa

SEQ ID NO: 5582 - DNA, 9 bp, Artificial Sequence
  Synthetic oligonucleotide
gagtgagaa

SEQ ID NO: 5583 - DNA, 9 bp, Artificial Sequence
  Synthetic oligonucleotide
gagtgaggt

SEQ ID NO: 5584 - DNA, 9 bp, Artificial Sequence
  Synthetic oligonucleotide
gagtgaggt

SEQ ID NO: 5585 - DNA, 9 bp, Artificial Sequence
  Synthetic oligonucleotide
gagtgaggg

SEQ ID NO: 5586 - DNA, 9 bp, Artificial Sequence
  Synthetic oligonucleotide
gagtgaggg

SEQ ID NO: 5587 - DNA, 9 bp, Artificial Sequence
  Synthetic oligonucleotide
gagtgaggt

SEQ ID NO: 5588 - DNA, 9 bp, Artificial Sequence
  Synthetic oligonucleotide
gagtgaggg

SEQ ID NO: 5589 - DNA, 9 bp, Artificial Sequence
  Synthetic oligonucleotide
gagtgaggt

SEQ ID NO: 5590 - DNA, 9 bp, Artificial Sequence
  Synthetic oligonucleotide
gagtgaggg

SEQ ID NO: 5591 - DNA, 9 bp, Artificial Sequence
  Synthetic oligonucleotide
gagtgagga

SEQ ID NO: 5592 - DNA, 9 bp, Artificial Sequence
  Synthetic oligonucleotide
gagtgagga

SEQ ID NO: 5593 - DNA, 9 bp, Artificial Sequence
  Synthetic oligonucleotide
gagtgagga

SEQ ID NO: 5594 - DNA, 9 bp, Artificial Sequence
  Synthetic oligonucleotide
gagtgagga

SEQ ID NO: 5595 - DNA, 9 bp, Artificial Sequence
  Synthetic oligonucleotide
gagtgagga

SEQ ID NO: 5596 - DNA, 9 bp, Artificial Sequence
  Synthetic oligonucleotide
gagtgagga

SEQ ID NO: 5597 - DNA, 9 bp, Artificial Sequence
  Synthetic oligonucleotide
gagtgagga

SEQ ID NO: 5598 - DNA, 9 bp, Artificial Sequence
  Synthetic oligonucleotide
gagtgagga

SEQ ID NO: 5599 - DNA, 9 bp, Artificial Sequence
  Synthetic oligonucleotide
gagtgagga

SEQ ID NO: 5600 - DNA, 9 bp, Artificial Sequence
  Synthetic oligonucleotide
gagtgagga

SEQ ID NO: 5601 - DNA, 9 bp, Artificial Sequence
  Synthetic oligonucleotide
gagtgagga

SEQ ID NO: 5602 - DNA, 9 bp, Artificial Sequence
  Synthetic oligonucleotide
gagtgagga

SEQ ID NO: 5603 - DNA, 9 bp, Artificial Sequence
  Synthetic oligonucleotide
gagtgagga

SEQ ID NO: 5604 - DNA, 9 bp, Artificial Sequence
  Synthetic oligonucleotide
gagtgagga

SEQ ID NO: 5605 - DNA, 9 bp, Artificial Sequence
  Synthetic oligonucleotide
gagtgagga

SEQ ID NO: 5606 - DNA, 9 bp, Artificial Sequence
  Synthetic oligonucleotide
gagtgagga

SEQ ID NO: 5607 - DNA, 9 bp, Artificial Sequence
  Synthetic oligonucleotide
gagtgagga

SEQ ID NO: 5608 - DNA, 9 bp, Artificial Sequence
  Synthetic oligonucleotide
gagtgagga

SEQ ID NO: 5609 - DNA, 9 bp, Artificial Sequence
  Synthetic oligonucleotide
gagtgagga

SEQ ID NO: 5610 - DNA, 9 bp, Artificial Sequence
  Synthetic oligonucleotide
gagtgagga

SEQ ID NO: 5611 - DNA, 9 bp, Artificial Sequence
  Synthetic oligonucleotide
gagtgagga

SEQ ID NO: 5612 - DNA, 9 bp, Artificial Sequence
  Synthetic oligonucleotide
gagtgagga

SEQ ID NO: 5613 - DNA, 9 bp, Artificial Sequence
  Synthetic oligonucleotide
gagtgagga

SEQ ID NO: 5614 - DNA, 9 bp, Artificial Sequence
  Synthetic oligonucleotide
gagtgagga

SEQ ID NO: 5615 - DNA, 9 bp, Artificial Sequence
  Synthetic oligonucleotide
gagtgagga

SEQ ID NO: 5616 - DNA, 9 bp, Artificial Sequence
  Synthetic oligonucleotide
gagtgagga

SEQ ID NO: 5617 - DNA, 9 bp, Artificial Sequence
  Synthetic oligonucleotide
gagtgagga

SEQ ID NO: 5618 - DNA, 9 bp, Artificial Sequence
  Synthetic oligonucleotide
gagtgagga

SEQ ID NO: 5619 - DNA, 9 bp, Artificial Sequence
  Synthetic oligonucleotide
gagtgagga

SEQ ID NO: 5620 - DNA, 9 bp, Artificial Sequence
  Synthetic oligonucleotide
gagtgagga

SEQ ID NO: 5621 - DNA, 9 bp, Artificial Sequence
  Synthetic oligonucleotide
gagtgagga

SEQ ID NO: 5622 - DNA, 9 bp, Artificial Sequence
  Synthetic oligonucleotide
gagtgagga

SEQ ID NO: 5623 - DNA, 9 bp, Artificial Sequence
  Synthetic oligonucleotide
gagtgagga

SEQ ID NO: 5624 - DNA, 9 bp, Artificial Sequence
  Synthetic oligonucleotide
gagtgagga

SEQ ID NO: 5625 - DNA, 9 bp, Artificial Sequence
  Synthetic oligonucleotide
gagtgagga

SEQ ID NO: 5626 - DNA, 9 bp, Artificial Sequence
  Synthetic oligonucleotide
gagtgagga

SEQ ID NO: 5627 - DNA, 9 bp, Artificial Sequence
  Synthetic oligonucleotide
gagtgagga

SEQ ID NO: 5628 - DNA, 9 bp, Artificial Sequence
  Synthetic oligonucleotide
gagtgagga

SEQ ID NO: 5629 - DNA, 9 bp, Artificial Sequence
  Synthetic oligonucleotide
gagtgagga

SEQ ID NO: 5630 - DNA, 9 bp, Artificial Sequence
  Synthetic oligonucleotide
gagtgagga

SEQ ID NO: 5631 - DNA, 9 bp, Artificial Sequence
  Synthetic oligonucleotide
gagtgagga

SEQ ID NO: 5632 - DNA, 9 bp, Artificial Sequence
  Synthetic oligonucleotide
gagtgagga

SEQ ID NO: 5633 - DNA, 9 bp, Artificial Sequence
  Synthetic oligonucleotide
gagtgagga

SEQ ID NO: 5634 - DNA, 9 bp, Artificial Sequence
  Synthetic oligonucleotide
gagtgagga

SEQ ID NO: 5635 - DNA, 9 bp, Artificial Sequence
  Synthetic oligonucleotide
gagtgagga

SEQ ID NO: 5636 - DNA, 9 bp, Artificial Sequence
  Synthetic oligonucleotide
gagtgagga

SEQ ID NO: 5637 - DNA, 9 bp, Artificial Sequence
  Synthetic oligonucleotide
gagtgagga

SEQ ID NO: 5638 - DNA, 9 bp, Artificial Sequence
  Synthetic oligonucleotide
gagtgagga

SEQ ID NO: 5639 - DNA, 9 bp, Artificial Sequence
  Synthetic oligonucleotide
gagtgagga

SEQ ID NO: 5640 - DNA, 9 bp, Artificial Sequence
  Synthetic oligonucleotide
gagtgagga

SEQ ID NO: 5641 - DNA, 9 bp, Artificial Sequence
  Synthetic oligonucleotide
gagtgagga

SEQ ID NO: 5642 - DNA, 9 bp, Artificial Sequence
  Synthetic oligonucleotide
cactgatca

SEQ ID NO: 5643 - DNA, 9 bp, Artificial Sequence
  Synthetic oligonucleotide
agaggagga

SEQ ID NO: 5644 - DNA, 9 bp, Artificial Sequence
  Synthetic oligonucleotide
gagtaggat

SEQ ID NO: 5645 - DNA, 9 bp, Artificial Sequence
  Synthetic oligonucleotide
acgtgcgca

SEQ ID NO: 5646 - DNA, 9 bp, Artificial Sequence
  Synthetic oligonucleotide
gtgcgagtc

SEQ ID NO: 5647 - DNA, 9 bp, Artificial Sequence
  Synthetic oligonucleotide
cagtgttta

SEQ ID NO: 5648 - DNA, 9 bp, Artificial Sequence
  Synthetic oligonucleotide
gagtgacac

SEQ ID NO: 5649 - DNA, 9 bp, Artificial Sequence
  Synthetic oligonucleotide
gagggtaga

SEQ ID NO: 5650 - DNA, 9 bp, Artificial Sequence
  Synthetic oligonucleotide
gagtaagtc

SEQ ID NO: 5651 - DNA, 9 bp, Artificial Sequence
  Synthetic oligonucleotide
gtgagagaa

SEQ ID NO: 5652 - DNA, 9 bp, Artificial Sequence
  Synthetic oligonucleotide
gtgagagaa

SEQ ID NO: 5653 - DNA, 9 bp, Artificial Sequence
  Synthetic oligonucleotide
gagtgatag

SEQ ID NO: 5654 - DNA, 9 bp, Artificial Sequence
  Synthetic oligonucleotide
gggtgatgc

SEQ ID NO: 5655 - DNA, 9 bp, Artificial Sequence
  Synthetic oligonucleotide
cagtgagcc

SEQ ID NO: 5656 - DNA, 9 bp, Artificial Sequence
  Synthetic oligonucleotide
gagtaagtg

SEQ ID NO: 5657 - DNA, 9 bp, Artificial Sequence
  Synthetic oligonucleotide
gagtatggg

SEQ ID NO: 5658 - DNA, 9 bp, Artificial Sequence
  Synthetic oligonucleotide
gtgtcaggc

SEQ ID NO: 5659 - DNA, 9 bp, Artificial Sequence
  Synthetic oligonucleotide
tggtgaggt

SEQ ID NO: 5660 - DNA, 9 bp, Artificial Sequence
  Synthetic oligonucleotide
gtgagggga

SEQ ID NO: 5661 - DNA, 9 bp, Artificial Sequence
  Synthetic oligonucleotide
cagtgagac

SEQ ID NO: 5662 - DNA, 9 bp, Artificial Sequence
  Synthetic oligonucleotide
gtaagagga

SEQ ID NO: 5663 - DNA, 9 bp, Artificial Sequence
  Synthetic oligonucleotide
gcgtgggaa

SEQ ID NO: 5664 - DNA, 9 bp, Artificial Sequence
  Synthetic oligonucleotide
gtgtgaggc

SEQ ID NO: 5665 - DNA, 9 bp, Artificial Sequence
  Synthetic oligonucleotide
aagtgaggg

SEQ ID NO: 5666 - DNA, 9 bp, Artificial Sequence
  Synthetic oligonucleotide
aagtgaggc

SEQ ID NO: 5667 - DNA, 9 bp, Artificial Sequence
  Synthetic oligonucleotide
gagtgagac

SEQ ID NO: 5668 - DNA, 9 bp, Artificial Sequence
  Synthetic oligonucleotide
aagtgaggg

SEQ ID NO: 5669 - DNA, 9 bp, Artificial Sequence
  Synthetic oligonucleotide
gagtgagat

SEQ ID NO: 5670 - DNA, 9 bp, Artificial Sequence
  Synthetic oligonucleotide
gagagtgga

SEQ ID NO: 5671 - DNA, 9 bp, Artificial Sequence
  Synthetic oligonucleotide
gagtaaggg

SEQ ID NO: 5672 - DNA, 9 bp, Artificial Sequence
  Synthetic oligonucleotide
gagtaacga

SEQ ID NO: 5673 - DNA, 9 bp, Artificial Sequence
  Synthetic oligonucleotide
cagtgaggg

SEQ ID NO: 5674 - DNA, 9 bp, Artificial Sequence
  Synthetic oligonucleotide
gtgtgaggt

SEQ ID NO: 5675 - DNA, 9 bp, Artificial Sequence
  Synthetic oligonucleotide
gagtaaggg

SEQ ID NO: 5676 - DNA, 9 bp, Artificial Sequence
  Synthetic oligonucleotide
gagtaaggg

SEQ ID NO: 5677 - DNA, 9 bp, Artificial Sequence
  Synthetic oligonucleotide
gagggaggc

SEQ ID NO: 5678 - DNA, 9 bp, Artificial Sequence
  Synthetic oligonucleotide
aagtgaggg

SEQ ID NO: 5679 - DNA, 9 bp, Artificial Sequence
  Synthetic oligonucleotide
gagtaaggt

SEQ ID NO: 5680 - DNA, 9 bp, Artificial Sequence
  Synthetic oligonucleotide
aagtgaggg

SEQ ID NO: 5681 - DNA, 9 bp, Artificial Sequence
  Synthetic oligonucleotide
cagtgaggg

SEQ ID NO: 5682 - DNA, 9 bp, Artificial Sequence
  Synthetic oligonucleotide
gagagaggt

SEQ ID NO: 5683 - DNA, 9 bp, Artificial Sequence
  Synthetic oligonucleotide
gtgtgaggc

SEQ ID NO: 5684 - DNA, 9 bp, Artificial Sequence
  Synthetic oligonucleotide
gagggaggc

SEQ ID NO: 5685 - DNA, 9 bp, Artificial Sequence
  Synthetic oligonucleotide
aagtgaggg

SEQ ID NO: 5686 - DNA, 9 bp, Artificial Sequence
  Synthetic oligonucleotide
gagggaggt

SEQ ID NO: 5687 - DNA, 9 bp, Artificial Sequence
  Synthetic oligonucleotide
gagtgagtc

SEQ ID NO: 5688 - DNA, 9 bp, Artificial Sequence
  Synthetic oligonucleotide
tagtgaggc

SEQ ID NO: 5689 - DNA, 9 bp, Artificial Sequence
  Synthetic oligonucleotide
aagtgaggg

SEQ ID NO: 5690 - DNA, 9 bp, Artificial Sequence
  Synthetic oligonucleotide
gagtaaggg

SEQ ID NO: 5691 - DNA, 9 bp, Artificial Sequence
  Synthetic oligonucleotide
aagtgaggc

SEQ ID NO: 5692 - DNA, 9 bp, Artificial Sequence
  Synthetic oligonucleotide
gtgtgaggc

SEQ ID NO: 5693 - DNA, 9 bp, Artificial Sequence
  Synthetic oligonucleotide
gagtgagtc

SEQ ID NO: 5694 - DNA, 9 bp, Artificial Sequence
  Synthetic oligonucleotide
gagtgaggg

SEQ ID NO: 5695 - DNA, 9 bp, Artificial Sequence
  Synthetic oligonucleotide
gagtgaggt

SEQ ID NO: 5696 - DNA, 9 bp, Artificial Sequence
  Synthetic oligonucleotide
gagtgaggg

SEQ ID NO: 5697 - DNA, 9 bp, Artificial Sequence
  Synthetic oligonucleotide
gagtgaggg

SEQ ID NO: 5698 - DNA, 9 bp, Artificial Sequence
  Synthetic oligonucleotide
gagtgaggg

SEQ ID NO: 5699 - DNA, 9 bp, Artificial Sequence
  Synthetic oligonucleotide
gagtgaggg

SEQ ID NO: 5700 - DNA, 9 bp, Artificial Sequence
  Synthetic oligonucleotide
gagtgaggc

SEQ ID NO: 5701 - DNA, 9 bp, Artificial Sequence
  Synthetic oligonucleotide
aagtgagga

SEQ ID NO: 5702 - DNA, 9 bp, Artificial Sequence
  Synthetic oligonucleotide
gagtgaggg

SEQ ID NO: 5703 - DNA, 9 bp, Artificial Sequence
  Synthetic oligonucleotide
gtgtgagga

SEQ ID NO: 5704 - DNA, 9 bp, Artificial Sequence
  Synthetic oligonucleotide
gagtgaggg

SEQ ID NO: 5705 - DNA, 9 bp, Artificial Sequence
  Synthetic oligonucleotide
aagtgagga

SEQ ID NO: 5706 - DNA, 9 bp, Artificial Sequence
  Synthetic oligonucleotide
gagtgaggc

SEQ ID NO: 5707 - DNA, 9 bp, Artificial Sequence
  Synthetic oligonucleotide
gagtgaggt

SEQ ID NO: 5708 - DNA, 9 bp, Artificial Sequence
  Synthetic oligonucleotide
gagtgaggg

SEQ ID NO: 5709 - DNA, 9 bp, Artificial Sequence
  Synthetic oligonucleotide
gagtgaggt

SEQ ID NO: 5710 - DNA, 9 bp, Artificial Sequence
  Synthetic oligonucleotide
gagtgaggg

SEQ ID NO: 5711 - DNA, 9 bp, Artificial Sequence
  Synthetic oligonucleotide
gagtgaggg

SEQ ID NO: 5712 - DNA, 9 bp, Artificial Sequence
  Synthetic oligonucleotide
gagtgaggt

SEQ ID NO: 5713 - DNA, 9 bp, Artificial Sequence
  Synthetic oligonucleotide
gagtgaggc

SEQ ID NO: 5714 - DNA, 9 bp, Artificial Sequence
  Synthetic oligonucleotide
gagtgaggt

SEQ ID NO: 5715 - DNA, 9 bp, Artificial Sequence
  Synthetic oligonucleotide
gagtgaggt

SEQ ID NO: 5716 - DNA, 9 bp, Artificial Sequence
  Synthetic oligonucleotide
gagtgaggg

SEQ ID NO: 5717 - DNA, 9 bp, Artificial Sequence
  Synthetic oligonucleotide
gagtgaggc

SEQ ID NO: 5718 - DNA, 9 bp, Artificial Sequence
  Synthetic oligonucleotide
gagtgaggg

SEQ ID NO: 5719 - DNA, 9 bp, Artificial Sequence
  Synthetic oligonucleotide
gagtgaggg

SEQ ID NO: 5720 - DNA, 9 bp, Artificial Sequence
  Synthetic oligonucleotide
gagtgaggg

SEQ ID NO: 5721 - DNA, 9 bp, Artificial Sequence
  Synthetic oligonucleotide
gagtgaggg

SEQ ID NO: 5722 - DNA, 9 bp, Artificial Sequence
  Synthetic oligonucleotide
gagtgaggg

SEQ ID NO: 5723 - DNA, 9 bp, Artificial Sequence
  Synthetic oligonucleotide
gagtgaggg

SEQ ID NO: 5724 - DNA, 9 bp, Artificial Sequence
  Synthetic oligonucleotide
gagtgaggg

SEQ ID NO: 5725 - DNA, 9 bp, Artificial Sequence
  Synthetic oligonucleotide
gagtgaggt

SEQ ID NO: 5726 - DNA, 9 bp, Artificial Sequence
  Synthetic oligonucleotide
gagtgaggc

SEQ ID NO: 5727 - DNA, 9 bp, Artificial Sequence
  Synthetic oligonucleotide
gagtgaggg

SEQ ID NO: 5728 - DNA, 9 bp, Artificial Sequence
  Synthetic oligonucleotide
gagtgaggt

SEQ ID NO: 5729 - DNA, 9 bp, Artificial Sequence
  Synthetic oligonucleotide
aagtgaggc

SEQ ID NO: 5730 - DNA, 9 bp, Artificial Sequence
  Synthetic oligonucleotide
aagtgaggg

SEQ ID NO: 5731 - DNA, 9 bp, Artificial Sequence
  Synthetic oligonucleotide
aagtgaggg

SEQ ID NO: 5732 - DNA, 9 bp, Artificial Sequence
  Synthetic oligonucleotide
cagtgagga

SEQ ID NO: 5733 - DNA, 9 bp, Artificial Sequence
  Synthetic oligonucleotide
cagtgaggc

SEQ ID NO: 5734 - DNA, 9 bp, Artificial Sequence
  Synthetic oligonucleotide
gagtgaggg

SEQ ID NO: 5735 - DNA, 9 bp, Artificial Sequence
  Synthetic oligonucleotide
gagtgaggg

SEQ ID NO: 5736 - DNA, 9 bp, Artificial Sequence
  Synthetic oligonucleotide
gagtgaggc

SEQ ID NO: 5737 - DNA, 9 bp, Artificial Sequence
  Synthetic oligonucleotide
gagtgaggc

SEQ ID NO: 5738 - DNA, 9 bp, Artificial Sequence
  Synthetic oligonucleotide
gagtgaggc

SEQ ID NO: 5739 - DNA, 9 bp, Artificial Sequence
  Synthetic oligonucleotide
gaatgagga

SEQ ID NO: 5740 - DNA, 9 bp, Artificial Sequence
  Synthetic oligonucleotide
gattgagga

SEQ ID NO: 5741 - DNA, 9 bp, Artificial Sequence
  Synthetic oligonucleotide
tagagatga

SEQ ID NO: 5742 - DNA, 9 bp, Artificial Sequence
  Synthetic oligonucleotide
aagtatgga

SEQ ID NO: 5743 - DNA, 9 bp, Artificial Sequence
  Synthetic oligonucleotide
tagtaatga

SEQ ID NO: 5744 - DNA, 9 bp, Artificial Sequence
  Synthetic oligonucleotide
tagtaatga

SEQ ID NO: 5745 - DNA, 9 bp, Artificial Sequence
  Synthetic oligonucleotide
aagagagga

SEQ ID NO: 5746 - DNA, 9 bp, Artificial Sequence
  Synthetic oligonucleotide
gagagagaa

SEQ ID NO: 5747 - DNA, 9 bp, Artificial Sequence
  Synthetic oligonucleotide
aagagagga

SEQ ID NO: 5748 - DNA, 9 bp, Artificial Sequence
  Synthetic oligonucleotide
gagtgaaaa

SEQ ID NO: 5749 - DNA, 9 bp, Artificial Sequence
  Synthetic oligonucleotide
gagagggga

SEQ ID NO: 5750 - DNA, 9 bp, Artificial Sequence
  Synthetic oligonucleotide
gagtgtggg

SEQ ID NO: 5751 - DNA, 9 bp, Artificial Sequence
  Synthetic oligonucleotide
gaaggagga

SEQ ID NO: 5752 - DNA, 9 bp, Artificial Sequence
  Synthetic oligonucleotide
gagagagaa

SEQ ID NO: 5753 - DNA, 9 bp, Artificial Sequence
  Synthetic oligonucleotide
gagtggggt

SEQ ID NO: 5754 - DNA, 9 bp, Artificial Sequence
  Synthetic oligonucleotide
gagagagaa

SEQ ID NO: 5755 - DNA, 9 bp, Artificial Sequence
  Synthetic oligonucleotide
gagtgagtt

SEQ ID NO: 5756 - DNA, 9 bp, Artificial Sequence
  Synthetic oligonucleotide
gggtgaggc

SEQ ID NO: 5757 - DNA, 9 bp, Artificial Sequence
  Synthetic oligonucleotide
gagggacga

SEQ ID NO: 5758 - DNA, 9 bp, Artificial Sequence
  Synthetic oligonucleotide
gggtgagca

SEQ ID NO: 5759 - DNA, 9 bp, Artificial Sequence
  Synthetic oligonucleotide
gagggagta

SEQ ID NO: 5760 - DNA, 9 bp, Artificial Sequence
  Synthetic oligonucleotide
aagtgaaga

SEQ ID NO: 5761 - DNA, 9 bp, Artificial Sequence
  Synthetic oligonucleotide
gggtgaggc

SEQ ID NO: 5762 - DNA, 9 bp, Artificial Sequence
  Synthetic oligonucleotide
gggtgagaa

SEQ ID NO: 5763 - DNA, 9 bp, Artificial Sequence
  Synthetic oligonucleotide
gagtaagaa

SEQ ID NO: 5764 - DNA, 9 bp, Artificial Sequence
  Synthetic oligonucleotide
gagcgaggg

SEQ ID NO: 5765 - DNA, 9 bp, Artificial Sequence
  Synthetic oligonucleotide
gactgagca

SEQ ID NO: 5766 - DNA, 9 bp, Artificial Sequence
  Synthetic oligonucleotide
gaatgaggc

SEQ ID NO: 5767 - DNA, 9 bp, Artificial Sequence
  Synthetic oligonucleotide
aagagagga

SEQ ID NO: 5768 - DNA, 9 bp, Artificial Sequence
  Synthetic oligonucleotide
gagtcaggg

SEQ ID NO: 5769 - DNA, 9 bp, Artificial Sequence
  Synthetic oligonucleotide
gagggagaa

SEQ ID NO: 5770 - DNA, 9 bp, Artificial Sequence
  Synthetic oligonucleotide
gactgaggg

SEQ ID NO: 5771 - DNA, 9 bp, Artificial Sequence
  Synthetic oligonucleotide
gaaggagga

SEQ ID NO: 5772 - DNA, 9 bp, Artificial Sequence
  Synthetic oligonucleotide
taatgagga

SEQ ID NO: 5773 - DNA, 9 bp, Artificial Sequence
  Synthetic oligonucleotide
gagagagaa

SEQ ID NO: 5774 - DNA, 9 bp, Artificial Sequence
  Synthetic oligonucleotide
gaatgaggc

SEQ ID NO: 5775 - DNA, 9 bp, Artificial Sequence
  Synthetic oligonucleotide
aggtgagga

SEQ ID NO: 5776 - DNA, 9 bp, Artificial Sequence
  Synthetic oligonucleotide
aagtgggga

SEQ ID NO: 5777 - DNA, 9 bp, Artificial Sequence
  Synthetic oligonucleotide
gagtgggga

SEQ ID NO: 5778 - DNA, 9 bp, Artificial Sequence
  Synthetic oligonucleotide
gtgtgagga

SEQ ID NO: 5779 - DNA, 9 bp, Artificial Sequence
  Synthetic oligonucleotide
gagttagga

SEQ ID NO: 5780 - DNA, 9 bp, Artificial Sequence
  Synthetic oligonucleotide
tagtgagga

SEQ ID NO: 5781 - DNA, 9 bp, Artificial Sequence
  Synthetic oligonucleotide
aagtgagga

SEQ ID NO: 5782 - DNA, 9 bp, Artificial Sequence
  Synthetic oligonucleotide
gagtgagta

SEQ ID NO: 5783 - DNA, 9 bp, Artificial Sequence
  Synthetic oligonucleotide
gagtgagca

SEQ ID NO: 5784 - DNA, 9 bp, Artificial Sequence
  Synthetic oligonucleotide
gagtcagga

SEQ ID NO: 5785 - DNA, 9 bp, Artificial Sequence
  Synthetic oligonucleotide
gagtgagta

SEQ ID NO: 5786 - DNA, 9 bp, Artificial Sequence
  Synthetic oligonucleotide
gagtgagaa

SEQ ID NO: 5787 - DNA, 9 bp, Artificial Sequence
  Synthetic oligonucleotide
gagcgagga

SEQ ID NO: 5788 - DNA, 9 bp, Artificial Sequence
  Synthetic oligonucleotide
aagtgagga

SEQ ID NO: 5789 - DNA, 9 bp, Artificial Sequence
  Synthetic oligonucleotide
gagttagga

SEQ ID NO: 5790 - DNA, 9 bp, Artificial Sequence
  Synthetic oligonucleotide
aagtgagga

SEQ ID NO: 5791 - DNA, 9 bp, Artificial Sequence
  Synthetic oligonucleotide
gtgtgagga

SEQ ID NO: 5792 - DNA, 9 bp, Artificial Sequence
  Synthetic oligonucleotide
gagagagga

SEQ ID NO: 5793 - DNA, 9 bp, Artificial Sequence
  Synthetic oligonucleotide
aagtgagga

SEQ ID NO: 5794 - DNA, 9 bp, Artificial Sequence
  Synthetic oligonucleotide
gagtgagca

SEQ ID NO: 5795 - DNA, 9 bp, Artificial Sequence
  Synthetic oligonucleotide
gagagagga

SEQ ID NO: 5796 - DNA, 9 bp, Artificial Sequence
  Synthetic oligonucleotide
gagggagga

SEQ ID NO: 5797 - DNA, 9 bp, Artificial Sequence
  Synthetic oligonucleotide
gagtgagta

SEQ ID NO: 5798 - DNA, 9 bp, Artificial Sequence
  Synthetic oligonucleotide
gaatgagga

SEQ ID NO: 5799 - DNA, 9 bp, Artificial Sequence
  Synthetic oligonucleotide
aagtgagga

SEQ ID NO: 5800 - DNA, 9 bp, Artificial Sequence
  Synthetic oligonucleotide
aagtgagga

SEQ ID NO: 5801 - DNA, 9 bp, Artificial Sequence
  Synthetic oligonucleotide
gagtgaggc

SEQ ID NO: 5802 - DNA, 9 bp, Artificial Sequence
  Synthetic oligonucleotide
gagtgagta

SEQ ID NO: 5803 - DNA, 9 bp, Artificial Sequence
  Synthetic oligonucleotide
gagtgagca

SEQ ID NO: 5804 - DNA, 9 bp, Artificial Sequence
  Synthetic oligonucleotide
gagggagga

SEQ ID NO: 5805 - DNA, 9 bp, Artificial Sequence
  Synthetic oligonucleotide
gagtgatga

SEQ ID NO: 5806 - DNA, 9 bp, Artificial Sequence
  Synthetic oligonucleotide
gagtcagga

SEQ ID NO: 5807 - DNA, 9 bp, Artificial Sequence
  Synthetic oligonucleotide
gagtgagaa

SEQ ID NO: 5808 - DNA, 9 bp, Artificial Sequence
  Synthetic oligonucleotide
gagtgagca

SEQ ID NO: 5809 - DNA, 9 bp, Artificial Sequence
  Synthetic oligonucleotide
cagtgagga

SEQ ID NO: 5810 - DNA, 9 bp, Artificial Sequence
  Synthetic oligonucleotide
gagcgagga

SEQ ID NO: 5811 - DNA, 9 bp, Artificial Sequence
  Synthetic oligonucleotide
gtgtgagga

SEQ ID NO: 5812 - DNA, 9 bp, Artificial Sequence
  Synthetic oligonucleotide
gagtgaaga

SEQ ID NO: 5813 - DNA, 9 bp, Artificial Sequence
  Synthetic oligonucleotide
gagtgagca

SEQ ID NO: 5814 - DNA, 9 bp, Artificial Sequence
  Synthetic oligonucleotide
gagtgtgga

SEQ ID NO: 5815 - DNA, 9 bp, Artificial Sequence
  Synthetic oligonucleotide
tagtgagga

SEQ ID NO: 5816 - DNA, 9 bp, Artificial Sequence
  Synthetic oligonucleotide
gagtgagga

SEQ ID NO: 5817 - DNA, 9 bp, Artificial Sequence
  Synthetic oligonucleotide
gagtgagga

SEQ ID NO: 5818 - DNA, 9 bp, Artificial Sequence
  Synthetic oligonucleotide
gagtgagga

SEQ ID NO: 5819 - DNA, 9 bp, Artificial Sequence
  Synthetic oligonucleotide
gagtgagga

SEQ ID NO: 5820 - DNA, 9 bp, Artificial Sequence
  Synthetic oligonucleotide
gagtgagga

SEQ ID NO: 5821 - DNA, 9 bp, Artificial Sequence
  Synthetic oligonucleotide
gagtgagga

SEQ ID NO: 5822 - DNA, 9 bp, Artificial Sequence
  Synthetic oligonucleotide
gagtgagga

SEQ ID NO: 5823 - DNA, 9 bp, Artificial Sequence
  Synthetic oligonucleotide
gagtgagga

SEQ ID NO: 5824 - DNA, 9 bp, Artificial Sequence
  Synthetic oligonucleotide
gagtgagga

SEQ ID NO: 5825 - DNA, 9 bp, Artificial Sequence
  Synthetic oligonucleotide
gagtgagga

SEQ ID NO: 5826 - DNA, 9 bp, Artificial Sequence
  Synthetic oligonucleotide
gagtgagga

SEQ ID NO: 5827 - DNA, 9 bp, Artificial Sequence
  Synthetic oligonucleotide
gagtgagga

SEQ ID NO: 5828 - DNA, 9 bp, Artificial Sequence
  Synthetic oligonucleotide
gagtgagga

SEQ ID NO: 5829 - DNA, 9 bp, Artificial Sequence
  Synthetic oligonucleotide
gagtgagga

SEQ ID NO: 5830 - DNA, 9 bp, Artificial Sequence
  Synthetic oligonucleotide
gagtgagga

SEQ ID NO: 5831 - DNA, 9 bp, Artificial Sequence
  Synthetic oligonucleotide
gagtgagga

SEQ ID NO: 5832 - DNA, 9 bp, Artificial Sequence
  Synthetic oligonucleotide
aagtggagg

SEQ ID NO: 5833 - DNA, 9 bp, Artificial Sequence
  Synthetic oligonucleotide
agtggagga

SEQ ID NO: 5834 - DNA, 9 bp, Artificial Sequence
  Synthetic oligonucleotide
gagttaacc

SEQ ID NO: 5835 - DNA, 9 bp, Artificial Sequence
  Synthetic oligonucleotide
aattgtgca

SEQ ID NO: 5836 - DNA, 9 bp, Artificial Sequence
  Synthetic oligonucleotide
gagggacca

SEQ ID NO: 5837 - DNA, 9 bp, Artificial Sequence
  Synthetic oligonucleotide
gagggagtc

SEQ ID NO: 5838 - DNA, 9 bp, Artificial Sequence
  Synthetic oligonucleotide
gtgtgtggc

SEQ ID NO: 5839 - DNA, 9 bp, Artificial Sequence
  Synthetic oligonucleotide
aactgaggt

SEQ ID NO: 5840 - DNA, 9 bp, Artificial Sequence
  Synthetic oligonucleotide
gactgaagc

SEQ ID NO: 5841 - DNA, 9 bp, Artificial Sequence
  Synthetic oligonucleotide
gagtgacat

SEQ ID NO: 5842 - DNA, 9 bp, Artificial Sequence
  Synthetic oligonucleotide
gagtgtgtc

SEQ ID NO: 5843 - DNA, 9 bp, Artificial Sequence
  Synthetic oligonucleotide
gaggcaaga

SEQ ID NO: 5844 - DNA, 9 bp, Artificial Sequence
  Synthetic oligonucleotide
gcgagaggc

SEQ ID NO: 5845 - DNA, 9 bp, Artificial Sequence
  Synthetic oligonucleotide
aagtgagac

SEQ ID NO: 5846 - DNA, 9 bp, Artificial Sequence
  Synthetic oligonucleotide
gagagggca

SEQ ID NO: 5847 - DNA, 9 bp, Artificial Sequence
  Synthetic oligonucleotide
gtgtgtgta

SEQ ID NO: 5848 - DNA, 9 bp, Artificial Sequence
  Synthetic oligonucleotide
gagtgaaag

SEQ ID NO: 5849 - DNA, 9 bp, Artificial Sequence
  Synthetic oligonucleotide
gagggagtc

SEQ ID NO: 5850 - DNA, 9 bp, Artificial Sequence
  Synthetic oligonucleotide
gagtgcgac

SEQ ID NO: 5851 - DNA, 9 bp, Artificial Sequence
  Synthetic oligonucleotide
aagtgcggg

SEQ ID NO: 5852 - DNA, 9 bp, Artificial Sequence
  Synthetic oligonucleotide
tggtgtgga

SEQ ID NO: 5853 - DNA, 9 bp, Artificial Sequence
  Synthetic oligonucleotide
gtgtgataa

SEQ ID NO: 5854 - DNA, 9 bp, Artificial Sequence
  Synthetic oligonucleotide
gagtgattt

SEQ ID NO: 5855 - DNA, 9 bp, Artificial Sequence
  Synthetic oligonucleotide
gtgtgcggc

SEQ ID NO: 5856 - DNA, 9 bp, Artificial Sequence
  Synthetic oligonucleotide
gagggtggt

SEQ ID NO: 5857 - DNA, 9 bp, Artificial Sequence
  Synthetic oligonucleotide
gagtgggac

SEQ ID NO: 5858 - DNA, 9 bp, Artificial Sequence
  Synthetic oligonucleotide
gagacaggc

SEQ ID NO: 5859 - DNA, 9 bp, Artificial Sequence
  Synthetic oligonucleotide
gtgtggggg

SEQ ID NO: 5860 - DNA, 9 bp, Artificial Sequence
  Synthetic oligonucleotide
gactgagag

SEQ ID NO: 5861 - DNA, 9 bp, Artificial Sequence
  Synthetic oligonucleotide
cagtaaggt

SEQ ID NO: 5862 - DNA, 9 bp, Artificial Sequence
  Synthetic oligonucleotide
aagcaagga

SEQ ID NO: 5863 - DNA, 9 bp, Artificial Sequence
  Synthetic oligonucleotide
gggagaggt

SEQ ID NO: 5864 - DNA, 9 bp, Artificial Sequence
  Synthetic oligonucleotide
tggtgtgga

SEQ ID NO: 5865 - DNA, 9 bp, Artificial Sequence
  Synthetic oligonucleotide
aagtgagat

SEQ ID NO: 5866 - DNA, 9 bp, Artificial Sequence
  Synthetic oligonucleotide
gagtgtgtc

SEQ ID NO: 5867 - DNA, 9 bp, Artificial Sequence
  Synthetic oligonucleotide
tagtgagct

SEQ ID NO: 5868 - DNA, 9 bp, Artificial Sequence
  Synthetic oligonucleotide
acgagagga

SEQ ID NO: 5869 - DNA, 9 bp, Artificial Sequence
  Synthetic oligonucleotide
gagggtggt

SEQ ID NO: 5870 - DNA, 9 bp, Artificial Sequence
  Synthetic oligonucleotide
gaggcaaga

SEQ ID NO: 5871 - DNA, 9 bp, Artificial Sequence
  Synthetic oligonucleotide
tggtgagga

SEQ ID NO: 5872 - DNA, 9 bp, Artificial Sequence
  Synthetic oligonucleotide
gggtgaggt

SEQ ID NO: 5873 - DNA, 9 bp, Artificial Sequence
  Synthetic oligonucleotide
gagagaggg

SEQ ID NO: 5874 - DNA, 9 bp, Artificial Sequence
  Synthetic oligonucleotide
gagtgtggg

SEQ ID NO: 5875 - DNA, 9 bp, Artificial Sequence
  Synthetic oligonucleotide
gagggaggc

SEQ ID NO: 5876 - DNA, 9 bp, Artificial Sequence
  Synthetic oligonucleotide
aagtgaggt

SEQ ID NO: 5877 - DNA, 9 bp, Artificial Sequence
  Synthetic oligonucleotide
gagtgagct

SEQ ID NO: 5878 - DNA, 9 bp, Artificial Sequence
  Synthetic oligonucleotide
cagtgagaa

SEQ ID NO: 5879 - DNA, 9 bp, Artificial Sequence
  Synthetic oligonucleotide
gagtgtggc

SEQ ID NO: 5880 - DNA, 9 bp, Artificial Sequence
  Synthetic oligonucleotide
gagcgaggg

SEQ ID NO: 5881 - DNA, 9 bp, Artificial Sequence
  Synthetic oligonucleotide
gagaaagga

SEQ ID NO: 5882 - DNA, 9 bp, Artificial Sequence
  Synthetic oligonucleotide
gagtgagag

SEQ ID NO: 5883 - DNA, 9 bp, Artificial Sequence
  Synthetic oligonucleotide
gagcaagga

SEQ ID NO: 5884 - DNA, 9 bp, Artificial Sequence
  Synthetic oligonucleotide
gagggaggg

SEQ ID NO: 5885 - DNA, 9 bp, Artificial Sequence
  Synthetic oligonucleotide
gcgtgaggc

SEQ ID NO: 5886 - DNA, 9 bp, Artificial Sequence
  Synthetic oligonucleotide
gagggaggt

SEQ ID NO: 5887 - DNA, 9 bp, Artificial Sequence
  Synthetic oligonucleotide
gagtgagtc

SEQ ID NO: 5888 - DNA, 9 bp, Artificial Sequence
  Synthetic oligonucleotide
tagtgaggc

SEQ ID NO: 5889 - DNA, 9 bp, Artificial Sequence
  Synthetic oligonucleotide
gagtgagcg

SEQ ID NO: 5890 - DNA, 9 bp, Artificial Sequence
  Synthetic oligonucleotide
aagtgaggc

SEQ ID NO: 5891 - DNA, 9 bp, Artificial Sequence
  Synthetic oligonucleotide
aagtgaggc

SEQ ID NO: 5892 - DNA, 9 bp, Artificial Sequence
  Synthetic oligonucleotide
gagggaggg

SEQ ID NO: 5893 - DNA, 9 bp, Artificial Sequence
  Synthetic oligonucleotide
gagagaggg

SEQ ID NO: 5894 - DNA, 9 bp, Artificial Sequence
  Synthetic oligonucleotide
gagtgtggg

SEQ ID NO: 5895 - DNA, 9 bp, Artificial Sequence
  Synthetic oligonucleotide
tagtgagta

SEQ ID NO: 5896 - DNA, 9 bp, Artificial Sequence
  Synthetic oligonucleotide
gagtgagat

SEQ ID NO: 5897 - DNA, 9 bp, Artificial Sequence
  Synthetic oligonucleotide
gagagaggc

SEQ ID NO: 5898 - DNA, 9 bp, Artificial Sequence
  Synthetic oligonucleotide
gagagaggg

SEQ ID NO: 5899 - DNA, 9 bp, Artificial Sequence
  Synthetic oligonucleotide
gagggaggg

SEQ ID NO: 5900 - DNA, 9 bp, Artificial Sequence
  Synthetic oligonucleotide
cagtgaggc

SEQ ID NO: 5901 - DNA, 9 bp, Artificial Sequence
  Synthetic oligonucleotide
cagtgaggt

SEQ ID NO: 5902 - DNA, 9 bp, Artificial Sequence
  Synthetic oligonucleotide
aagtgagaa

SEQ ID NO: 5903 - DNA, 9 bp, Artificial Sequence
  Synthetic oligonucleotide
gagtgaaaa

SEQ ID NO: 5904 - DNA, 9 bp, Artificial Sequence
  Synthetic oligonucleotide
aagtgaggt

SEQ ID NO: 5905 - DNA, 9 bp, Artificial Sequence
  Synthetic oligonucleotide
gtgtgaggt

SEQ ID NO: 5906 - DNA, 9 bp, Artificial Sequence
  Synthetic oligonucleotide
gagtgagcc

SEQ ID NO: 5907 - DNA, 9 bp, Artificial Sequence
  Synthetic oligonucleotide
gagtaaggg

SEQ ID NO: 5908 - DNA, 9 bp, Artificial Sequence
  Synthetic oligonucleotide
gagggaggc

SEQ ID NO: 5909 - DNA, 9 bp, Artificial Sequence
  Synthetic oligonucleotide
tagtgaggc

SEQ ID NO: 5910 - DNA, 9 bp, Artificial Sequence
  Synthetic oligonucleotide
gagtgaata

SEQ ID NO: 5911 - DNA, 9 bp, Artificial Sequence
  Synthetic oligonucleotide
gagtaaggc

SEQ ID NO: 5912 - DNA, 9 bp, Artificial Sequence
  Synthetic oligonucleotide
cagtgaggc

SEQ ID NO: 5913 - DNA, 9 bp, Artificial Sequence
  Synthetic oligonucleotide
gagtgagag

SEQ ID NO: 5914 - DNA, 9 bp, Artificial Sequence
  Synthetic oligonucleotide
gagtgagat

SEQ ID NO: 5915 - DNA, 9 bp, Artificial Sequence
  Synthetic oligonucleotide
gagtgagct

SEQ ID NO: 5916 - DNA, 9 bp, Artificial Sequence
  Synthetic oligonucleotide
gtgtgaggt

SEQ ID NO: 5917 - DNA, 9 bp, Artificial Sequence
  Synthetic oligonucleotide
gggtgaggc

SEQ ID NO: 5918 - DNA, 9 bp, Artificial Sequence
  Synthetic oligonucleotide
gtgtgaggt

SEQ ID NO: 5919 - DNA, 9 bp, Artificial Sequence
  Synthetic oligonucleotide
tagtgaggt

SEQ ID NO: 5920 - DNA, 9 bp, Artificial Sequence
  Synthetic oligonucleotide
gagagaggt

SEQ ID NO: 5921 - DNA, 9 bp, Artificial Sequence
  Synthetic oligonucleotide
gggtgaggc

SEQ ID NO: 5922 - DNA, 9 bp, Artificial Sequence
  Synthetic oligonucleotide
gagtgagat

SEQ ID NO: 5923 - DNA, 9 bp, Artificial Sequence
  Synthetic oligonucleotide
gagtgagag

SEQ ID NO: 5924 - DNA, 9 bp, Artificial Sequence
  Synthetic oligonucleotide
gagagaggg

SEQ ID NO: 5925 - DNA, 9 bp, Artificial Sequence
  Synthetic oligonucleotide
gagtgaggc

SEQ ID NO: 5926 - DNA, 9 bp, Artificial Sequence
  Synthetic oligonucleotide
gagtgaggg

SEQ ID NO: 5927 - DNA, 9 bp, Artificial Sequence
  Synthetic oligonucleotide
gagtgaggc

SEQ ID NO: 5928 - DNA, 9 bp, Artificial Sequence
  Synthetic oligonucleotide
gagtgaggg

SEQ ID NO: 5929 - DNA, 9 bp, Artificial Sequence
  Synthetic oligonucleotide
gagtgaggc

SEQ ID NO: 5930 - DNA, 9 bp, Artificial Sequence
  Synthetic oligonucleotide
gagtgaggt

SEQ ID NO: 5931 - DNA, 9 bp, Artificial Sequence
  Synthetic oligonucleotide
gagtgaggt

SEQ ID NO: 5932 - DNA, 9 bp, Artificial Sequence
  Synthetic oligonucleotide
gagtgaggc

SEQ ID NO: 5933 - DNA, 9 bp, Artificial Sequence
  Synthetic oligonucleotide
gagtgaggg

SEQ ID NO: 5934 - DNA, 9 bp, Artificial Sequence
  Synthetic oligonucleotide
gagtgaggg

SEQ ID NO: 5935 - DNA, 9 bp, Artificial Sequence
  Synthetic oligonucleotide
gagtgaggg

SEQ ID NO: 5936 - DNA, 9 bp, Artificial Sequence
  Synthetic oligonucleotide
cagtgagga

SEQ ID NO: 5937 - DNA, 9 bp, Artificial Sequence
  Synthetic oligonucleotide
gagtgaggc

SEQ ID NO: 5938 - DNA, 9 bp, Artificial Sequence
  Synthetic oligonucleotide
gagtgaggc

SEQ ID NO: 5939 - DNA, 9 bp, Artificial Sequence
  Synthetic oligonucleotide
gagtgaggg

SEQ ID NO: 5940 - DNA, 9 bp, Artificial Sequence
  Synthetic oligonucleotide
gagggagga

SEQ ID NO: 5941 - DNA, 9 bp, Artificial Sequence
  Synthetic oligonucleotide
gagtgaaga

SEQ ID NO: 5942 - DNA, 9 bp, Artificial Sequence
  Synthetic oligonucleotide
gagtgaggt

SEQ ID NO: 5943 - DNA, 9 bp, Artificial Sequence
  Synthetic oligonucleotide
gagtgaggg

SEQ ID NO: 5944 - DNA, 9 bp, Artificial Sequence
  Synthetic oligonucleotide
gagtgaggg

SEQ ID NO: 5945 - DNA, 9 bp, Artificial Sequence
  Synthetic oligonucleotide
gagtgaggt

SEQ ID NO: 5946 - DNA, 9 bp, Artificial Sequence
  Synthetic oligonucleotide
gagtgtgga

SEQ ID NO: 5947 - DNA, 9 bp, Artificial Sequence
  Synthetic oligonucleotide
gagtgaggg

SEQ ID NO: 5948 - DNA, 9 bp, Artificial Sequence
  Synthetic oligonucleotide
gagtgaggc

SEQ ID NO: 5949 - DNA, 9 bp, Artificial Sequence
  Synthetic oligonucleotide
gagtgaggc

SEQ ID NO: 5950 - DNA, 9 bp, Artificial Sequence
  Synthetic oligonucleotide
gagtgagca

SEQ ID NO: 5951 - DNA, 9 bp, Artificial Sequence
  Synthetic oligonucleotide
gagtgaggt

SEQ ID NO: 5952 - DNA, 9 bp, Artificial Sequence
  Synthetic oligonucleotide
gagtgaggt

SEQ ID NO: 5953 - DNA, 9 bp, Artificial Sequence
  Synthetic oligonucleotide
gagtgaggc

SEQ ID NO: 5954 - DNA, 9 bp, Artificial Sequence
  Synthetic oligonucleotide
gagtgagaa

SEQ ID NO: 5955 - DNA, 9 bp, Artificial Sequence
  Synthetic oligonucleotide
gagtgaggg

SEQ ID NO: 5956 - DNA, 9 bp, Artificial Sequence
  Synthetic oligonucleotide
aagtgagga

SEQ ID NO: 5957 - DNA, 9 bp, Artificial Sequence
  Synthetic oligonucleotide
gagtgaggc

SEQ ID NO: 5958 - DNA, 9 bp, Artificial Sequence
  Synthetic oligonucleotide
aagtgagga

SEQ ID NO: 5959 - DNA, 9 bp, Artificial Sequence
  Synthetic oligonucleotide
gagtgaggg

SEQ ID NO: 5960 - DNA, 9 bp, Artificial Sequence
  Synthetic oligonucleotide
gagtgaggt

SEQ ID NO: 5961 - DNA, 9 bp, Artificial Sequence
  Synthetic oligonucleotide
gagtgaggt

SEQ ID NO: 5962 - DNA, 9 bp, Artificial Sequence
  Synthetic oligonucleotide
gagtgaggt

SEQ ID NO: 5963 - DNA, 9 bp, Artificial Sequence
  Synthetic oligonucleotide
gagtgaggt

SEQ ID NO: 5964 - DNA, 9 bp, Artificial Sequence
  Synthetic oligonucleotide
gagtgaggg

SEQ ID NO: 5965 - DNA, 9 bp, Artificial Sequence
  Synthetic oligonucleotide
gagtgaggg

SEQ ID NO: 5966 - DNA, 9 bp, Artificial Sequence
  Synthetic oligonucleotide
aagtgagga

SEQ ID NO: 5967 - DNA, 9 bp, Artificial Sequence
  Synthetic oligonucleotide
gagtgaggc

SEQ ID NO: 5968 - DNA, 9 bp, Artificial Sequence
  Synthetic oligonucleotide
gagtgaggc

SEQ ID NO: 5969 - DNA, 9 bp, Artificial Sequence
  Synthetic oligonucleotide
gagtgaggt

SEQ ID NO: 5970 - DNA, 9 bp, Artificial Sequence
  Synthetic oligonucleotide
gagtgaggg

SEQ ID NO: 5971 - DNA, 9 bp, Artificial Sequence
  Synthetic oligonucleotide
gagtgaggt

SEQ ID NO: 5972 - DNA, 9 bp, Artificial Sequence
  Synthetic oligonucleotide
gagtgaggt

SEQ ID NO: 5973 - DNA, 9 bp, Artificial Sequence
  Synthetic oligonucleotide
gagtgaggc

SEQ ID NO: 5974 - DNA, 9 bp, Artificial Sequence
  Synthetic oligonucleotide
gagtgaggc

SEQ ID NO: 5975 - DNA, 9 bp, Artificial Sequence
  Synthetic oligonucleotide
gagtgaggc

SEQ ID NO: 5976 - DNA, 9 bp, Artificial Sequence
  Synthetic oligonucleotide
gagtgaggc

SEQ ID NO: 5977 - DNA, 9 bp, Artificial Sequence
  Synthetic oligonucleotide
gagtgagta

SEQ ID NO: 5978 - DNA, 9 bp, Artificial Sequence
  Synthetic oligonucleotide
gagtgaggc

SEQ ID NO: 5979 - DNA, 9 bp, Artificial Sequence
  Synthetic oligonucleotide
gagtgaggc

SEQ ID NO: 5980 - DNA, 9 bp, Artificial Sequence
  Synthetic oligonucleotide
gagtgaggt

SEQ ID NO: 5981 - DNA, 9 bp, Artificial Sequence
  Synthetic oligonucleotide
gagtgaggt

SEQ ID NO: 5982 - DNA, 9 bp, Artificial Sequence
  Synthetic oligonucleotide
gagtgaggg

SEQ ID NO: 5983 - DNA, 9 bp, Artificial Sequence
  Synthetic oligonucleotide
gagtgaggc

SEQ ID NO: 5984 - DNA, 9 bp, Artificial Sequence
  Synthetic oligonucleotide
gagtgagaa

SEQ ID NO: 5985 - DNA, 9 bp, Artificial Sequence
  Synthetic oligonucleotide
gagggagga

SEQ ID NO: 5986 - DNA, 9 bp, Artificial Sequence
  Synthetic oligonucleotide
gagtgagca

SEQ ID NO: 5987 - DNA, 9 bp, Artificial Sequence
  Synthetic oligonucleotide
cagtgagga

SEQ ID NO: 5988 - DNA, 9 bp, Artificial Sequence
  Synthetic oligonucleotide
gagtgaggg

SEQ ID NO: 5989 - DNA, 9 bp, Artificial Sequence
  Synthetic oligonucleotide
gagtgaggt

SEQ ID NO: 5990 - DNA, 9 bp, Artificial Sequence
  Synthetic oligonucleotide
gagtgaggt

SEQ ID NO: 5991 - DNA, 9 bp, Artificial Sequence
  Synthetic oligonucleotide
gagtgaggc

SEQ ID NO: 5992 - DNA, 9 bp, Artificial Sequence
  Synthetic oligonucleotide
gagtgaggg

SEQ ID NO: 5993 - DNA, 9 bp, Artificial Sequence
  Synthetic oligonucleotide
gagtgaggc

SEQ ID NO: 5994 - DNA, 9 bp, Artificial Sequence
  Synthetic oligonucleotide
gagtgaggg

SEQ ID NO: 5995 - DNA, 9 bp, Artificial Sequence
  Synthetic oligonucleotide
gagtgaggg

SEQ ID NO: 5996 - DNA, 9 bp, Artificial Sequence
  Synthetic oligonucleotide
gagtgaggc

SEQ ID NO: 5997 - DNA, 9 bp, Artificial Sequence
  Synthetic oligonucleotide
gagtgaggg

SEQ ID NO: 5998 - DNA, 9 bp, Artificial Sequence
  Synthetic oligonucleotide
gagtgagaa

SEQ ID NO: 5999 - DNA, 9 bp, Artificial Sequence
  Synthetic oligonucleotide
gagtgaggt

SEQ ID NO: 6000 - DNA, 9 bp, Artificial Sequence
  Synthetic oligonucleotide
gagtgaggc

SEQ ID NO: 6001 - DNA, 9 bp, Artificial Sequence
  Synthetic oligonucleotide
gagtgaggt

SEQ ID NO: 6002 - DNA, 9 bp, Artificial Sequence
  Synthetic oligonucleotide
gagtgaggg

SEQ ID NO: 6003 - DNA, 9 bp, Artificial Sequence
  Synthetic oligonucleotide
cagtgagga

SEQ ID NO: 6004 - DNA, 9 bp, Artificial Sequence
  Synthetic oligonucleotide
cagtgagga

SEQ ID NO: 6005 - DNA, 9 bp, Artificial Sequence
  Synthetic oligonucleotide
gagtgaggg

SEQ ID NO: 6006 - DNA, 9 bp, Artificial Sequence
  Synthetic oligonucleotide
gagtgaggc

SEQ ID NO: 6007 - DNA, 9 bp, Artificial Sequence
  Synthetic oligonucleotide
gagtgaggc

SEQ ID NO: 6008 - DNA, 9 bp, Artificial Sequence
  Synthetic oligonucleotide
gagtgaggc

SEQ ID NO: 6009 - DNA, 9 bp, Artificial Sequence
  Synthetic oligonucleotide
gagtgaggg

SEQ ID NO: 6010 - DNA, 9 bp, Artificial Sequence
  Synthetic oligonucleotide
gagtgaggg

SEQ ID NO: 6011 - DNA, 9 bp, Artificial Sequence
  Synthetic oligonucleotide
gagtgagta

SEQ ID NO: 6012 - DNA, 9 bp, Artificial Sequence
  Synthetic oligonucleotide
gagtgaggg

SEQ ID NO: 6013 - DNA, 9 bp, Artificial Sequence
  Synthetic oligonucleotide
gagtgaggg

SEQ ID NO: 6014 - DNA, 9 bp, Artificial Sequence
  Synthetic oligonucleotide
gagtgagta

SEQ ID NO: 6015 - DNA, 9 bp, Artificial Sequence
  Synthetic oligonucleotide
gagtgaggt

SEQ ID NO: 6016 - DNA, 9 bp, Artificial Sequence
  Synthetic oligonucleotide
gagtgaggg

SEQ ID NO: 6017 - DNA, 9 bp, Artificial Sequence
  Synthetic oligonucleotide
gagtgaggc

SEQ ID NO: 6018 - DNA, 9 bp, Artificial Sequence
  Synthetic oligonucleotide
tagtgagga

SEQ ID NO: 6019 - DNA, 9 bp, Artificial Sequence
  Synthetic oligonucleotide
gagtgaggc

SEQ ID NO: 6020 - DNA, 9 bp, Artificial Sequence
  Synthetic oligonucleotide
gagtgagga

SEQ ID NO: 6021 - DNA, 9 bp, Artificial Sequence
  Synthetic oligonucleotide
gagtgagga

SEQ ID NO: 6022 - DNA, 9 bp, Artificial Sequence
  Synthetic oligonucleotide
gagtgagga

SEQ ID NO: 6023 - DNA, 9 bp, Artificial Sequence
  Synthetic oligonucleotide
gagtgagga

SEQ ID NO: 6024 - DNA, 9 bp, Artificial Sequence
  Synthetic oligonucleotide
gagtgagga

SEQ ID NO: 6025 - DNA, 9 bp, Artificial Sequence
  Synthetic oligonucleotide
gagtgagga

SEQ ID NO: 6026 - DNA, 9 bp, Artificial Sequence
  Synthetic oligonucleotide
gagtgagga

SEQ ID NO: 6027 - DNA, 9 bp, Artificial Sequence
  Synthetic oligonucleotide
gagtgagga

SEQ ID NO: 6028 - DNA, 9 bp, Artificial Sequence
  Synthetic oligonucleotide
gagtgagga

SEQ ID NO: 6029 - DNA, 9 bp, Artificial Sequence
  Synthetic oligonucleotide
gagtgagga

SEQ ID NO: 6030 - DNA, 9 bp, Artificial Sequence
  Synthetic oligonucleotide
gagtgagga

SEQ ID NO: 6031 - DNA, 9 bp, Artificial Sequence
  Synthetic oligonucleotide
gagtgagga

SEQ ID NO: 6032 - DNA, 9 bp, Artificial Sequence
  Synthetic oligonucleotide
gagtgagga

SEQ ID NO: 6033 - DNA, 9 bp, Artificial Sequence
  Synthetic oligonucleotide
gagtgagga

SEQ ID NO: 6034 - DNA, 9 bp, Artificial Sequence
  Synthetic oligonucleotide
gagtgagga

SEQ ID NO: 6035 - DNA, 9 bp, Artificial Sequence
  Synthetic oligonucleotide
gagtgagga

SEQ ID NO: 6036 - DNA, 9 bp, Artificial Sequence
  Synthetic oligonucleotide
gagtgagga

SEQ ID NO: 6037 - DNA, 9 bp, Artificial Sequence
  Synthetic oligonucleotide
gagtgagga

SEQ ID NO: 6038 - DNA, 9 bp, Artificial Sequence
  Synthetic oligonucleotide
gagtgagga

SEQ ID NO: 6039 - DNA, 9 bp, Artificial Sequence
  Synthetic oligonucleotide
gagtgagga

SEQ ID NO: 6040 - DNA, 9 bp, Artificial Sequence
  Synthetic oligonucleotide
gagtgagga

SEQ ID NO: 6041 - DNA, 9 bp, Artificial Sequence
  Synthetic oligonucleotide
gagtgagga

SEQ ID NO: 6042 - DNA, 9 bp, Artificial Sequence
  Synthetic oligonucleotide
gagtgagga

SEQ ID NO: 6043 - DNA, 9 bp, Artificial Sequence
  Synthetic oligonucleotide
gagtgagga

SEQ ID NO: 6044 - DNA, 9 bp, Artificial Sequence
  Synthetic oligonucleotide
gagtgagga

SEQ ID NO: 6045 - DNA, 9 bp, Artificial Sequence
  Synthetic oligonucleotide
gagtgagga

SEQ ID NO: 6046 - DNA, 9 bp, Artificial Sequence
  Synthetic oligonucleotide
gagtgagga

SEQ ID NO: 6047 - DNA, 9 bp, Artificial Sequence
  Synthetic oligonucleotide
gagtgagga

SEQ ID NO: 6048 - DNA, 9 bp, Artificial Sequence
  Synthetic oligonucleotide
gagtgagga

SEQ ID NO: 6049 - DNA, 9 bp, Artificial Sequence
  Synthetic oligonucleotide
gagtgagga

SEQ ID NO: 6050 - DNA, 9 bp, Artificial Sequence
  Synthetic oligonucleotide
gagtgagga

SEQ ID NO: 6051 - DNA, 9 bp, Artificial Sequence
  Synthetic oligonucleotide
gagtgagga

SEQ ID NO: 6052 - DNA, 9 bp, Artificial Sequence
  Synthetic oligonucleotide
gagtgagga

SEQ ID NO: 6053 - DNA, 9 bp, Artificial Sequence
  Synthetic oligonucleotide
gagtgagga

SEQ ID NO: 6054 - DNA, 9 bp, Artificial Sequence
  Synthetic oligonucleotide
gagtgagga

SEQ ID NO: 6055 - DNA, 9 bp, Artificial Sequence
  Synthetic oligonucleotide
gagtgagga

SEQ ID NO: 6056 - DNA, 9 bp, Artificial Sequence
  Synthetic oligonucleotide
gagtgagga

SEQ ID NO: 6057 - DNA, 9 bp, Artificial Sequence
  Synthetic oligonucleotide
gagtgagga

SEQ ID NO: 6058 - DNA, 9 bp, Artificial Sequence
  Synthetic oligonucleotide
gagtgagga

SEQ ID NO: 6059 - DNA, 9 bp, Artificial Sequence
  Synthetic oligonucleotide
gagtgagga

SEQ ID NO: 6060 - DNA, 9 bp, Artificial Sequence
  Synthetic oligonucleotide
gagtgagga

SEQ ID NO: 6061 - DNA, 9 bp, Artificial Sequence
  Synthetic oligonucleotide
gagtgagga

SEQ ID NO: 6062 - DNA, 9 bp, Artificial Sequence
  Synthetic oligonucleotide
gagtgagga

SEQ ID NO: 6063 - DNA, 9 bp, Artificial Sequence
  Synthetic oligonucleotide
gagtgagga

SEQ ID NO: 6064 - DNA, 9 bp, Artificial Sequence
  Synthetic oligonucleotide
gagtgagga

SEQ ID NO: 6065 - DNA, 9 bp, Artificial Sequence
  Synthetic oligonucleotide
gagtgagga

SEQ ID NO: 6066 - DNA, 9 bp, Artificial Sequence
  Synthetic oligonucleotide
cagaaaggt

SEQ ID NO: 6067 - DNA, 9 bp, Artificial Sequence
  Synthetic oligonucleotide
tagtgagac

SEQ ID NO: 6068 - DNA, 9 bp, Artificial Sequence
  Synthetic oligonucleotide
ttgtgaggg

SEQ ID NO: 6069 - DNA, 9 bp, Artificial Sequence
  Synthetic oligonucleotide
ttgtgaggg

SEQ ID NO: 6070 - DNA, 9 bp, Artificial Sequence
  Synthetic oligonucleotide
gagggagat

SEQ ID NO: 6071 - DNA, 9 bp, Artificial Sequence
  Synthetic oligonucleotide
gagggagat

SEQ ID NO: 6072 - DNA, 9 bp, Artificial Sequence
  Synthetic oligonucleotide
ttgtgaggt

SEQ ID NO: 6073 - DNA, 9 bp, Artificial Sequence
  Synthetic oligonucleotide
ttgtgaggt

SEQ ID NO: 6074 - DNA, 9 bp, Artificial Sequence
  Synthetic oligonucleotide
tagtgaata

SEQ ID NO: 6075 - DNA, 9 bp, Artificial Sequence
  Synthetic oligonucleotide
ttgtgaggg

SEQ ID NO: 6076 - DNA, 9 bp, Artificial Sequence
  Synthetic oligonucleotide
gagggagat

SEQ ID NO: 6077 - DNA, 9 bp, Artificial Sequence
  Synthetic oligonucleotide
aagtaaggg

SEQ ID NO: 6078 - DNA, 9 bp, Artificial Sequence
  Synthetic oligonucleotide
gagtgagag

SEQ ID NO: 6079 - DNA, 9 bp, Artificial Sequence
  Synthetic oligonucleotide
gagtgagtc

SEQ ID NO: 6080 - DNA, 9 bp, Artificial Sequence
  Synthetic oligonucleotide
gagtgagcc

SEQ ID NO: 6081 - DNA, 9 bp, Artificial Sequence
  Synthetic oligonucleotide
gagtgagtc

SEQ ID NO: 6082 - DNA, 9 bp, Artificial Sequence
  Synthetic oligonucleotide
gagtgagtc

SEQ ID NO: 6083 - DNA, 9 bp, Artificial Sequence
  Synthetic oligonucleotide
gagtgagtc

SEQ ID NO: 6084 - DNA, 9 bp, Artificial Sequence
  Synthetic oligonucleotide
gagtaaggg

SEQ ID NO: 6085 - DNA, 9 bp, Artificial Sequence
  Synthetic oligonucleotide
gagtgagag

SEQ ID NO: 6086 - DNA, 9 bp, Artificial Sequence
  Synthetic oligonucleotide
gagggaggg

SEQ ID NO: 6087 - DNA, 9 bp, Artificial Sequence
  Synthetic oligonucleotide
gagtgagag

SEQ ID NO: 6088 - DNA, 9 bp, Artificial Sequence
  Synthetic oligonucleotide
gagtgagat

SEQ ID NO: 6089 - DNA, 9 bp, Artificial Sequence
  Synthetic oligonucleotide
gagggaggt

SEQ ID NO: 6090 - DNA, 9 bp, Artificial Sequence
  Synthetic oligonucleotide
gagtgtggt

SEQ ID NO: 6091 - DNA, 9 bp, Artificial Sequence
  Synthetic oligonucleotide
gagggaggg

SEQ ID NO: 6092 - DNA, 9 bp, Artificial Sequence
  Synthetic oligonucleotide
gagtaaggg

SEQ ID NO: 6093 - DNA, 9 bp, Artificial Sequence
  Synthetic oligonucleotide
gagtgagtg

SEQ ID NO: 6094 - DNA, 9 bp, Artificial Sequence
  Synthetic oligonucleotide
gagggaggt

SEQ ID NO: 6095 - DNA, 9 bp, Artificial Sequence
  Synthetic oligonucleotide
gagtaaggg

SEQ ID NO: 6096 - DNA, 9 bp, Artificial Sequence
  Synthetic oligonucleotide
gagtgagag

SEQ ID NO: 6097 - DNA, 9 bp, Artificial Sequence
  Synthetic oligonucleotide
gagtgaggg

SEQ ID NO: 6098 - DNA, 9 bp, Artificial Sequence
  Synthetic oligonucleotide
gagtgaggt

SEQ ID NO: 6099 - DNA, 9 bp, Artificial Sequence
  Synthetic oligonucleotide
gagtgaggc

SEQ ID NO: 6100 - DNA, 9 bp, Artificial Sequence
  Synthetic oligonucleotide
gagtgaggc

SEQ ID NO: 6101 - DNA, 9 bp, Artificial Sequence
  Synthetic oligonucleotide
gagtgaggc

SEQ ID NO: 6102 - DNA, 9 bp, Artificial Sequence
  Synthetic oligonucleotide
gagtgaggg

SEQ ID NO: 6103 - DNA, 9 bp, Artificial Sequence
  Synthetic oligonucleotide
gagtgaggg

SEQ ID NO: 6104 - DNA, 9 bp, Artificial Sequence
  Synthetic oligonucleotide
gagtgaggc

SEQ ID NO: 6105 - DNA, 9 bp, Artificial Sequence
  Synthetic oligonucleotide
gagtgaggc

SEQ ID NO: 6106 - DNA, 9 bp, Artificial Sequence
  Synthetic oligonucleotide
gagtgaggg

SEQ ID NO: 6107 - DNA, 9 bp, Artificial Sequence
  Synthetic oligonucleotide
gagtgaggc

SEQ ID NO: 6108 - DNA, 9 bp, Artificial Sequence
  Synthetic oligonucleotide
gagtgaggc

SEQ ID NO: 6109 - DNA, 9 bp, Artificial Sequence
  Synthetic oligonucleotide
gagtgaggc

SEQ ID NO: 6110 - DNA, 9 bp, Artificial Sequence
  Synthetic oligonucleotide
gagtgaggt

SEQ ID NO: 6111 - DNA, 9 bp, Artificial Sequence
  Synthetic oligonucleotide
gagtgaggt

SEQ ID NO: 6112 - DNA, 9 bp, Artificial Sequence
  Synthetic oligonucleotide
gagtgaggc

SEQ ID NO: 6113 - DNA, 9 bp, Artificial Sequence
  Synthetic oligonucleotide
gagtgaggt

SEQ ID NO: 6114 - DNA, 9 bp, Artificial Sequence
  Synthetic oligonucleotide
gagtgaggc

SEQ ID NO: 6115 - DNA, 9 bp, Artificial Sequence
  Synthetic oligonucleotide
gagagagga

SEQ ID NO: 6116 - DNA, 9 bp, Artificial Sequence
  Synthetic oligonucleotide
gagtgaggg

SEQ ID NO: 6117 - DNA, 9 bp, Artificial Sequence
  Synthetic oligonucleotide
gagtgaggc

SEQ ID NO: 6118 - DNA, 9 bp, Artificial Sequence
  Synthetic oligonucleotide
gagtgaggt

SEQ ID NO: 6119 - DNA, 9 bp, Artificial Sequence
  Synthetic oligonucleotide
gagtgaggc

SEQ ID NO: 6120 - DNA, 9 bp, Artificial Sequence
  Synthetic oligonucleotide
gagtgagag

SEQ ID NO: 6121 - DNA, 9 bp, Artificial Sequence
  Synthetic oligonucleotide
gagtcaggg

SEQ ID NO: 6122 - DNA, 9 bp, Artificial Sequence
  Synthetic oligonucleotide
gagtgagga

SEQ ID NO: 6123 - DNA, 9 bp, Artificial Sequence
  Synthetic oligonucleotide
gggtgaggg

SEQ ID NO: 6124 - DNA, 9 bp, Artificial Sequence
  Synthetic oligonucleotide
gagtgtggc

SEQ ID NO: 6125 - DNA, 9 bp, Artificial Sequence
  Synthetic oligonucleotide
gagtgagag

SEQ ID NO: 6126 - DNA, 9 bp, Artificial Sequence
  Synthetic oligonucleotide
gagtgagag

SEQ ID NO: 6127 - DNA, 9 bp, Artificial Sequence
  Synthetic oligonucleotide
gagggaggt

SEQ ID NO: 6128 - DNA, 9 bp, Artificial Sequence
  Synthetic oligonucleotide
gagtgagag

SEQ ID NO: 6129 - DNA, 9 bp, Artificial Sequence
  Synthetic oligonucleotide
gggtgaggc

SEQ ID NO: 6130 - DNA, 9 bp, Artificial Sequence
  Synthetic oligonucleotide
gagtgaggt

SEQ ID NO: 6131 - DNA, 9 bp, Artificial Sequence
  Synthetic oligonucleotide
gagtgaggc

SEQ ID NO: 6132 - DNA, 9 bp, Artificial Sequence
  Synthetic oligonucleotide
gactgagga

SEQ ID NO: 6133 - DNA, 9 bp, Artificial Sequence
  Synthetic oligonucleotide
gtgtgggga

SEQ ID NO: 6134 - DNA, 9 bp, Artificial Sequence
  Synthetic oligonucleotide
gtgtgggga

SEQ ID NO: 6135 - DNA, 9 bp, Artificial Sequence
  Synthetic oligonucleotide
gagtgaggt

SEQ ID NO: 6136 - DNA, 9 bp, Artificial Sequence
  Synthetic oligonucleotide
gagtgaggt

SEQ ID NO: 6137 - DNA, 9 bp, Artificial Sequence
  Synthetic oligonucleotide
gagtgagga

SEQ ID NO: 6138 - DNA, 9 bp, Artificial Sequence
  Synthetic oligonucleotide
gacactgga

SEQ ID NO: 6139 - DNA, 9 bp, Artificial Sequence
  Synthetic oligonucleotide
aggtgaggc

SEQ ID NO: 6140 - DNA, 9 bp, Artificial Sequence
  Synthetic oligonucleotide
gagggtaga

SEQ ID NO: 6141 - DNA, 9 bp, Artificial Sequence
  Synthetic oligonucleotide
gggtgaggc

SEQ ID NO: 6142 - DNA, 9 bp, Artificial Sequence
  Synthetic oligonucleotide
gagtgaaga

SEQ ID NO: 6143 - DNA, 9 bp, Artificial Sequence
  Synthetic oligonucleotide
gagtgaggc

SEQ ID NO: 6144 - DNA, 9 bp, Artificial Sequence
  Synthetic oligonucleotide
gagtgaggc

SEQ ID NO: 6145 - DNA, 9 bp, Artificial Sequence
  Synthetic oligonucleotide
gagtgaggg

SEQ ID NO: 6146 - DNA, 9 bp, Artificial Sequence
  Synthetic oligonucleotide
aagtgagga

SEQ ID NO: 6147 - DNA, 9 bp, Artificial Sequence
  Synthetic oligonucleotide
gagtgaggc

SEQ ID NO: 6148 - DNA, 9 bp, Artificial Sequence
  Synthetic oligonucleotide
gagtgatga

SEQ ID NO: 6149 - DNA, 9 bp, Artificial Sequence
  Synthetic oligonucleotide
aagtgagga

SEQ ID NO: 6150 - DNA, 9 bp, Artificial Sequence
  Synthetic oligonucleotide
gagtgaggg

SEQ ID NO: 6151 - DNA, 9 bp, Artificial Sequence
  Synthetic oligonucleotide
gagtgagga

SEQ ID NO: 6152 - DNA, 9 bp, Artificial Sequence
  Synthetic oligonucleotide
gagtgaggc

SEQ ID NO: 6153 - DNA, 23 bp, Artificial Sequence
  Synthetic oligonucleotide
agcagcttccttttgagtgagaa

SEQ ID NO: 6154 - DNA, 24 bp, Artificial Sequence
  Synthetic oligonucleotide
agcatcgtcatcagacagtgagga

SEQ ID NO: 6155 - DNA, 23 bp, Artificial Sequence
  Synthetic oligonucleotide
agcaacgtcgtagtgattgagga

SEQ ID NO: 6156 - DNA, 23 bp, Artificial Sequence
  Synthetic oligonucleotide
agctgggtcatgaggagtgagga

SEQ ID NO: 6157 - DNA, 23 bp, Artificial Sequence
  Synthetic oligonucleotide
agctgggtcatgaggagtgagga

SEQ ID NO: 6158 - DNA, 24 bp, Artificial Sequence
  Synthetic oligonucleotide
agcaacttctggaaagagtgagga

SEQ ID NO: 6159 - DNA, 23 bp, Artificial Sequence
  Synthetic oligonucleotide
agctgagtcttaaggagtgagga

SEQ ID NO: 6160 - DNA, 24 bp, Artificial Sequence
  Synthetic oligonucleotide
tccagcgtcctcccagagtgagga

SEQ ID NO: 6161 - DNA, 24 bp, Artificial Sequence
  Synthetic oligonucleotide
tgcagcgttaaaatagagtgagga

SEQ ID NO: 6162 - DNA, 23 bp, Artificial Sequence
  Synthetic oligonucleotide
agcaccttcaattggagtgagga

SEQ ID NO: 6163 - DNA, 24 bp, Artificial Sequence
  Synthetic oligonucleotide
tgcagcggcgtaggggagtgagga

SEQ ID NO: 6164 - DNA, 24 bp, Artificial Sequence
  Synthetic oligonucleotide
agcagggttcttcaagagtgagga

SEQ ID NO: 6165 - DNA, 24 bp, Artificial Sequence
  Synthetic oligonucleotide
agcagcatagatatggagtgagga

SEQ ID NO: 6166 - DNA, 24 bp, Artificial Sequence
  Synthetic oligonucleotide
aacagcttctctgaggagtgagga

SEQ ID NO: 6167 - DNA, 24 bp, Artificial Sequence
  Synthetic oligonucleotide
tgcagggtcgggcaggagtgagga

SEQ ID NO: 6168 - DNA, 23 bp, Artificial Sequence
  Synthetic oligonucleotide
agcaaagtcaaacagagtgagga

SEQ ID NO: 6169 - DNA, 24 bp, Artificial Sequence
  Synthetic oligonucleotide
aacagcttctcgggagagtgagga

SEQ ID NO: 6170 - DNA, 23 bp, Artificial Sequence
  Synthetic oligonucleotide
agtagcggcaaattgagtgagga

SEQ ID NO: 6171 - DNA, 23 bp, Artificial Sequence
  Synthetic oligonucleotide
agctgagtcctaaagagtgagga

SEQ ID NO: 6172 - DNA, 23 bp, Artificial Sequence
  Synthetic oligonucleotide
agcagcgagaaagagagtgagga

SEQ ID NO: 6173 - DNA, 23 bp, Artificial Sequence
  Synthetic oligonucleotide
tgcagtgtccacaagagtgagga

SEQ ID NO: 6174 - DNA, 24 bp, Artificial Sequence
  Synthetic oligonucleotide
agcagcataatagcagagtgagga

SEQ ID NO: 6175 - DNA, 23 bp, Artificial Sequence
  Synthetic oligonucleotide
agcagcatatcagggagtgagga

SEQ ID NO: 6176 - DNA, 23 bp, Artificial Sequence
  Synthetic oligonucleotide
agcagcggtcttaggagtgagga

SEQ ID NO: 6177 - DNA, 24 bp, Artificial Sequence
  Synthetic oligonucleotide
aacagcttcatctcggagtgagga

SEQ ID NO: 6178 - DNA, 23 bp, Artificial Sequence
  Synthetic oligonucleotide
ggcagagtcctagagagtgagga

SEQ ID NO: 6179 - DNA, 23 bp, Artificial Sequence
  Synthetic oligonucleotide
agctgtgtcttggagagtgagga

SEQ ID NO: 6180 - DNA, 23 bp, Artificial Sequence
  Synthetic oligonucleotide
agtggcgtcccagtgagtgagga

SEQ ID NO: 6181 - DNA, 23 bp, Artificial Sequence
  Synthetic oligonucleotide
agctgtgtccacaggagtgagga

SEQ ID NO: 6182 - DNA, 24 bp, Artificial Sequence
  Synthetic oligonucleotide
agcagcggcttaagggggtgaggt

SEQ ID NO: 6183 - DNA, 24 bp, Artificial Sequence
  Synthetic oligonucleotide
agcaacgtctaacccgagtgttga

SEQ ID NO: 6184 - DNA, 23 bp, Artificial Sequence
  Synthetic oligonucleotide
agcaccgtccccctcagtgaggc

SEQ ID NO: 6185 - DNA, 23 bp, Artificial Sequence
  Synthetic oligonucleotide
agcagcggcggctgcagtgaggc

SEQ ID NO: 6186 - DNA, 24 bp, Artificial Sequence
  Synthetic oligonucleotide
agcagtgtctaaaaggagtgagat

SEQ ID NO: 6187 - DNA, 24 bp, Artificial Sequence
  Synthetic oligonucleotide
agcaacgtccatagtgtgtgagaa

SEQ ID NO: 6188 - DNA, 24 bp, Artificial Sequence
  Synthetic oligonucleotide
agaaacgtcgtggaggagtgaggg

SEQ ID NO: 6189 - DNA, 24 bp, Artificial Sequence
  Synthetic oligonucleotide
agcatagtctaggccgagtgaggc

SEQ ID NO: 6190 - DNA, 23 bp, Artificial Sequence
  Synthetic oligonucleotide
agcaacttcatcttgagtgaggg

SEQ ID NO: 6191 - DNA, 23 bp, Artificial Sequence
  Synthetic oligonucleotide
agcagggtggcgtggagtgaggc

SEQ ID NO: 6192 - DNA, 23 bp, Artificial Sequence
  Synthetic oligonucleotide
agcacggtcatgatgagtgaggc

SEQ ID NO: 6193 - DNA, 23 bp, Artificial Sequence
  Synthetic oligonucleotide
agcattgtctcctggagtgaggg

SEQ ID NO: 6194 - DNA, 23 bp, Artificial Sequence
  Synthetic oligonucleotide
agcaccgtggcttcgagtgaggc

SEQ ID NO: 6195 - DNA, 23 bp, Artificial Sequence
  Synthetic oligonucleotide
agcaacttcctggcgagtgaggg

SEQ ID NO: 6196 - DNA, 24 bp, Artificial Sequence
  Synthetic oligonucleotide
agcaacatctggttggagtgaggg

SEQ ID NO: 6197 - DNA, 24 bp, Artificial Sequence
  Synthetic oligonucleotide
ggcagcggccgctgtgagtgaggt

SEQ ID NO: 6198 - DNA, 24 bp, Artificial Sequence
  Synthetic oligonucleotide
agcattgtctcatgtgagtgaggt

SEQ ID NO: 6199 - DNA, 23 bp, Artificial Sequence
  Synthetic oligonucleotide
agcagcagctaggggagtgaggg

SEQ ID NO: 6200 - DNA, 24 bp, Artificial Sequence
  Synthetic oligonucleotide
agcagcagcccacaggagtgaggg

SEQ ID NO: 6201 - DNA, 23 bp, Artificial Sequence
  Synthetic oligonucleotide
atcagagtctctgggagtgaggc

SEQ ID NO: 6202 - DNA, 24 bp, Artificial Sequence
  Synthetic oligonucleotide
atcagtgtccctcaggagtgaggc

SEQ ID NO: 6203 - DNA, 23 bp, Artificial Sequence
  Synthetic oligonucleotide
agcaacatcatcttgagtgaggg

SEQ ID NO: 6204 - DNA, 23 bp, Artificial Sequence
  Synthetic oligonucleotide
agcatggtcccaaggagtgaggg

SEQ ID NO: 6205 - DNA, 24 bp, Artificial Sequence
  Synthetic oligonucleotide
agcaaagtctgtactgagtgaggg

SEQ ID NO: 6206 - DNA, 23 bp, Artificial Sequence
  Synthetic oligonucleotide
agcagctcctctccgagtgaggt

SEQ ID NO: 6207 - DNA, 23 bp, Artificial Sequence
  Synthetic oligonucleotide
agcaatgtcaaaaagagtgaggc

SEQ ID NO: 6208 - DNA, 23 bp, Artificial Sequence
  Synthetic oligonucleotide
agtagcgtttttaggagtgaggt

SEQ ID NO: 6209 - DNA, 24 bp, Artificial Sequence
  Synthetic oligonucleotide
ggcagagtcagggctgagtgaggc

SEQ ID NO: 6210 - DNA, 23 bp, Artificial Sequence
  Synthetic oligonucleotide
tgcagcttcatggtgagtgaggc

SEQ ID NO: 6211 - DNA, 24 bp, Artificial Sequence
  Synthetic oligonucleotide
agcatagttacctgggagtgagga

SEQ ID NO: 6212 - DNA, 24 bp, Artificial Sequence
  Synthetic oligonucleotide
agtaaagtctaagtagagtgagga

SEQ ID NO: 6213 - DNA, 23 bp, Artificial Sequence
  Synthetic oligonucleotide
agcattgttctgcggagtgagga

SEQ ID NO: 6214 - DNA, 23 bp, Artificial Sequence
  Synthetic oligonucleotide
tgcagtctccttgggagtgaggt

SEQ ID NO: 6215 - DNA, 24 bp, Artificial Sequence
  Synthetic oligonucleotide
agcagcgtccacttccagagagga

SEQ ID NO: 6216 - DNA, 24 bp, Artificial Sequence
  Synthetic oligonucleotide
agcagcgtggacccagagtgagca

SEQ ID NO: 6217 - DNA, 23 bp, Artificial Sequence
  Synthetic oligonucleotide
agcagcgccaatccgagtgagaa

SEQ ID NO: 6218 - DNA, 23 bp, Artificial Sequence
  Synthetic oligonucleotide
agcagcggcaggctgagagagga

SEQ ID NO: 6219 - DNA, 24 bp, Artificial Sequence
  Synthetic oligonucleotide
agcagcttctgccttgagtgagta

SEQ ID NO: 6220 - DNA, 23 bp, Artificial Sequence
  Synthetic oligonucleotide
agcagcttcactgtcagtgagga

SEQ ID NO: 6221 - DNA, 23 bp, Artificial Sequence
  Synthetic oligonucleotide
atcagcgtcttcagaagtgagga

SEQ ID NO: 6222 - DNA, 24 bp, Artificial Sequence
  Synthetic oligonucleotide
agcagcgtggacccagagtgagca

SEQ ID NO: 6223 - DNA, 24 bp, Artificial Sequence
  Synthetic oligonucleotide
agcagggtcaagaaagagtgagta

SEQ ID NO: 6224 - DNA, 23 bp, Artificial Sequence
  Synthetic oligonucleotide
agcagcgttacacagagtgggga

SEQ ID NO: 6225 - DNA, 24 bp, Artificial Sequence
  Synthetic oligonucleotide
agcagcggcaagagagaatgagga

SEQ ID NO: 6226 - DNA, 23 bp, Artificial Sequence
  Synthetic oligonucleotide
agcagagtccaggcaagtgagga

SEQ ID NO: 6227 - DNA, 23 bp, Artificial Sequence
  Synthetic oligonucleotide
agcagagtccaggcaagtgagga

SEQ ID NO: 6228 - DNA, 24 bp, Artificial Sequence
  Synthetic oligonucleotide
agcagggtctgggtagagtgatga

SEQ ID NO: 6229 - DNA, 24 bp, Artificial Sequence
  Synthetic oligonucleotide
agcagcgtggacccagagtgagca

SEQ ID NO: 6230 - DNA, 24 bp, Artificial Sequence
  Synthetic oligonucleotide
agcagcagctagctagagtgagga

SEQ ID NO: 6231 - DNA, 23 bp, Artificial Sequence
  Synthetic oligonucleotide
aggagcttcactaagagtgagga

SEQ ID NO: 6232 - DNA, 23 bp, Artificial Sequence
  Synthetic oligonucleotide
agcagcctgcaatagagtgagga

SEQ ID NO: 6233 - DNA, 24 bp, Artificial Sequence
  Synthetic oligonucleotide
accagtgtctgagctgagtgagga

SEQ ID NO: 6234 - DNA, 23 bp, Artificial Sequence
  Synthetic oligonucleotide
aacagagtccccatgagtgagga

SEQ ID NO: 6235 - DNA, 24 bp, Artificial Sequence
  Synthetic oligonucleotide
agcagcctggccagggagtgagga

SEQ ID NO: 6236 - DNA, 23 bp, Artificial Sequence
  Synthetic oligonucleotide
agcagcagcagtgagagtgagga

SEQ ID NO: 6237 - DNA, 23 bp, Artificial Sequence
  Synthetic oligonucleotide
atcagagtcttagggagtgagga

SEQ ID NO: 6238 - DNA, 24 bp, Artificial Sequence
  Synthetic oligonucleotide
agcggggtctagggggagtgagga

SEQ ID NO: 6239 - DNA, 23 bp, Artificial Sequence
  Synthetic oligonucleotide
agcagcggacaagtgagtgagga

SEQ ID NO: 6240 - DNA, 24 bp, Artificial Sequence
  Synthetic oligonucleotide
agcagcgtccctgcctagggaggg

SEQ ID NO: 6241 - DNA, 24 bp, Artificial Sequence
  Synthetic oligonucleotide
agcagcgtcttttctatgtgaggc

SEQ ID NO: 6242 - DNA, 24 bp, Artificial Sequence
  Synthetic oligonucleotide
agcagcgtcacctctgtgtggggc

SEQ ID NO: 6243 - DNA, 23 bp, Artificial Sequence
  Synthetic oligonucleotide
agcagcgtctaagggaggggggt

SEQ ID NO: 6244 - DNA, 23 bp, Artificial Sequence
  Synthetic oligonucleotide
agcagcgtcttggggtgtggggc

SEQ ID NO: 6245 - DNA, 23 bp, Artificial Sequence
  Synthetic oligonucleotide
agcagcgtctagagtagagaggt

SEQ ID NO: 6246 - DNA, 24 bp, Artificial Sequence
  Synthetic oligonucleotide
agcagggtctcccaggagtgtgaa

SEQ ID NO: 6247 - DNA, 23 bp, Artificial Sequence
  Synthetic oligonucleotide
agcagtgtctatttcagtgaggg

SEQ ID NO: 6248 - DNA, 24 bp, Artificial Sequence
  Synthetic oligonucleotide
agcagggtcagcccagagtggggg

SEQ ID NO: 6249 - DNA, 23 bp, Artificial Sequence
  Synthetic oligonucleotide
agcagggtcaggcacagtgaggc

SEQ ID NO: 6250 - DNA, 23 bp, Artificial Sequence
  Synthetic oligonucleotide
agcagggtcctctggagtggggg

SEQ ID NO: 6251 - DNA, 23 bp, Artificial Sequence
  Synthetic oligonucleotide
ggcagcgtccggaggagtgaagg

SEQ ID NO: 6252 - DNA, 24 bp, Artificial Sequence
  Synthetic oligonucleotide
ggcagcgtcactccagagttaggt

SEQ ID NO: 6253 - DNA, 24 bp, Artificial Sequence
  Synthetic oligonucleotide
agcagggtcattcatcagtgaggc

SEQ ID NO: 6254 - DNA, 24 bp, Artificial Sequence
  Synthetic oligonucleotide
agcagagtcctgtcagagggaggc

SEQ ID NO: 6255 - DNA, 23 bp, Artificial Sequence
  Synthetic oligonucleotide
agcagcatcttctggagtgagac

SEQ ID NO: 6256 - DNA, 23 bp, Artificial Sequence
  Synthetic oligonucleotide
agcatcgtctttctgtgtgaggc

SEQ ID NO: 6257 - DNA, 24 bp, Artificial Sequence
  Synthetic oligonucleotide
agcagtgtctcacaggagggaggg

SEQ ID NO: 6258 - DNA, 23 bp, Artificial Sequence
  Synthetic oligonucleotide
ggcagcgtccaggagagagaggt

SEQ ID NO: 6259 - DNA, 23 bp, Artificial Sequence
  Synthetic oligonucleotide
agcagcggccccgggagttaggt

SEQ ID NO: 6260 - DNA, 24 bp, Artificial Sequence
  Synthetic oligonucleotide
agcagcggcgggtgggagtggggg

SEQ ID NO: 6261 - DNA, 23 bp, Artificial Sequence
  Synthetic oligonucleotide
agcagtgtccagacgagggaggt

SEQ ID NO: 6262 - DNA, 23 bp, Artificial Sequence
  Synthetic oligonucleotide
agcagtgtctatgagagggaggg

SEQ ID NO: 6263 - DNA, 24 bp, Artificial Sequence
  Synthetic oligonucleotide
agcagtgtcagccatgagggaggg

SEQ ID NO: 6264 - DNA, 24 bp, Artificial Sequence
  Synthetic oligonucleotide
agcagtgtccctgtggagggaggt

SEQ ID NO: 6265 - DNA, 23 bp, Artificial Sequence
  Synthetic oligonucleotide
agcaccgtctgccagagtgggca

SEQ ID NO: 6266 - DNA, 23 bp, Artificial Sequence
  Synthetic oligonucleotide
agccacgtccacactagtgagga

SEQ ID NO: 6267 - DNA, 23 bp, Artificial Sequence
  Synthetic oligonucleotide
agtagcgccaaaaggagtgaggt

SEQ ID NO: 6268 - DNA, 24 bp, Artificial Sequence
  Synthetic oligonucleotide
aacagggtctttgacgagtgaggc

SEQ ID NO: 6269 - DNA, 23 bp, Artificial Sequence
  Synthetic oligonucleotide
ggcagggtctcaatgagtgaggg

SEQ ID NO: 6270 - DNA, 23 bp, Artificial Sequence
  Synthetic oligonucleotide
aacagggtccctgagagtgaggg

SEQ ID NO: 6271 - DNA, 23 bp, Artificial Sequence
  Synthetic oligonucleotide
aggagagtccaggtgagtgaggg

SEQ ID NO: 6272 - DNA, 23 bp, Artificial Sequence
  Synthetic oligonucleotide
agcagccgccaacagagtgaggg

SEQ ID NO: 6273 - DNA, 24 bp, Artificial Sequence
  Synthetic oligonucleotide
ggcagagtcagtgttgagtgaggg

SEQ ID NO: 6274 - DNA, 24 bp, Artificial Sequence
  Synthetic oligonucleotide
agcagtgtgtgagctgagtgaggc

SEQ ID NO: 6275 - DNA, 23 bp, Artificial Sequence
  Synthetic oligonucleotide
agcatcttccagtggagtgaggg

SEQ ID NO: 6276 - DNA, 23 bp, Artificial Sequence
  Synthetic oligonucleotide
agcagagtggttgagagtgaggt

SEQ ID NO: 6277 - DNA, 23 bp, Artificial Sequence
  Synthetic oligonucleotide
atcagtgtcccagagagtgaggg

SEQ ID NO: 6278 - DNA, 24 bp, Artificial Sequence
  Synthetic oligonucleotide
ttcagcgtccaagaagagtgaggt

SEQ ID NO: 6279 - DNA, 24 bp, Artificial Sequence
  Synthetic oligonucleotide
agcaacttccggacagagtaagga

SEQ ID NO: 6280 - DNA, 23 bp, Artificial Sequence
  Synthetic oligonucleotide
agcagcgggagatggagtgaggc

SEQ ID NO: 6281 - DNA, 23 bp, Artificial Sequence
  Synthetic oligonucleotide
agtagcgtggagaggagtgaggt

SEQ ID NO: 6282 - DNA, 23 bp, Artificial Sequence
  Synthetic oligonucleotide
agctgcatctttgggagtgaggt

SEQ ID NO: 6283 - DNA, 24 bp, Artificial Sequence
  Synthetic oligonucleotide
atcagagtcaaagaagagtgaggt

SEQ ID NO: 6284 - DNA, 24 bp, Artificial Sequence
  Synthetic oligonucleotide
agcaggatctgaaatgagtgaggt

SEQ ID NO: 6285 - DNA, 24 bp, Artificial Sequence
  Synthetic oligonucleotide
agccacgtccagttttagtgagga

SEQ ID NO: 6286 - DNA, 24 bp, Artificial Sequence
  Synthetic oligonucleotide
agcaatgtctcaaatcagtgagga

SEQ ID NO: 6287 - DNA, 23 bp, Artificial Sequence
  Synthetic oligonucleotide
agcaatgtctgaaacagtgagga

SEQ ID NO: 6288 - DNA, 23 bp, Artificial Sequence
  Synthetic oligonucleotide
ggctgcgtcatcgggagtgaggt

SEQ ID NO: 6289 - DNA, 23 bp, Artificial Sequence
  Synthetic oligonucleotide
ggcagagtcaaaatgagtgaggt

SEQ ID NO: 6290 - DNA, 23 bp, Artificial Sequence
  Synthetic oligonucleotide
agcagtgtgcatgtgagtgaggt

SEQ ID NO: 6291 - DNA, 24 bp, Artificial Sequence
  Synthetic oligonucleotide
ggcaacatcaaacaggagtgagga

SEQ ID NO: 6292 - DNA, 24 bp, Artificial Sequence
  Synthetic oligonucleotide
cccagcggctggcaggagtgagga

SEQ ID NO: 6293 - DNA, 24 bp, Artificial Sequence
  Synthetic oligonucleotide
agcctggtcggagaggagtgagga

SEQ ID NO: 6294 - DNA, 23 bp, Artificial Sequence
  Synthetic oligonucleotide
tgcagtctctatgggagtgagga

SEQ ID NO: 6295 - DNA, 23 bp, Artificial Sequence
  Synthetic oligonucleotide
agcattgtagaggcgagtgagga

SEQ ID NO: 6296 - DNA, 23 bp, Artificial Sequence
  Synthetic oligonucleotide
agcctggtctcacagagtgagga

SEQ ID NO: 6297 - DNA, 23 bp, Artificial Sequence
  Synthetic oligonucleotide
agcatagtgaatatgagtgagga

SEQ ID NO: 6298 - DNA, 23 bp, Artificial Sequence
  Synthetic oligonucleotide
agcaaaggcaccaggagtgagga

SEQ ID NO: 6299 - DNA, 23 bp, Artificial Sequence
  Synthetic oligonucleotide
aacatggtccacgtgagtgagga

SEQ ID NO: 6300 - DNA, 24 bp, Artificial Sequence
  Synthetic oligonucleotide
agctttgtcaacctagagtgagga

SEQ ID NO: 6301 - DNA, 23 bp, Artificial Sequence
  Synthetic oligonucleotide
agcaaaggcaaaaagagtgagga

SEQ ID NO: 6302 - DNA, 23 bp, Artificial Sequence
  Synthetic oligonucleotide
atcaaggtcttttggagtgagga

SEQ ID NO: 6303 - DNA, 24 bp, Artificial Sequence
  Synthetic oligonucleotide
gccagtgtctcgtctgagtgagga

SEQ ID NO: 6304 - DNA, 24 bp, Artificial Sequence
  Synthetic oligonucleotide
tgcaaagtcagatctgagtgagga

SEQ ID NO: 6305 - DNA, 23 bp, Artificial Sequence
  Synthetic oligonucleotide
agcaacgtctacaggaggaaggt

SEQ ID NO: 6306 - DNA, 24 bp, Artificial Sequence
  Synthetic oligonucleotide
agcaacgtcccaggaaagtgaagg

SEQ ID NO: 6307 - DNA, 24 bp, Artificial Sequence
  Synthetic oligonucleotide
ggcagtgtccagtaggagtgagat

SEQ ID NO: 6308 - DNA, 23 bp, Artificial Sequence
  Synthetic oligonucleotide
agcaaagtctcacaaagtgaggt

SEQ ID NO: 6309 - DNA, 24 bp, Artificial Sequence
  Synthetic oligonucleotide
tgctgtgtcaaacccgagtgaggt

SEQ ID NO: 6310 - DNA, 24 bp, Artificial Sequence
  Synthetic oligonucleotide
ggcaaggtctctgtggagtgaggg

SEQ ID NO: 6311 - DNA, 23 bp, Artificial Sequence
  Synthetic oligonucleotide
atcaacgtgtctcagagtgaggc

SEQ ID NO: 6312 - DNA, 24 bp, Artificial Sequence
  Synthetic oligonucleotide
agcagcgtctgaggcgggtgagaa

SEQ ID NO: 6313 - DNA, 24 bp, Artificial Sequence
  Synthetic oligonucleotide
agcagcgtctgcatggtgtgggga

SEQ ID NO: 6314 - DNA, 23 bp, Artificial Sequence
  Synthetic oligonucleotide
agcagagtcaggcagagtgagaa

SEQ ID NO: 6315 - DNA, 24 bp, Artificial Sequence
  Synthetic oligonucleotide
agcagcttcatttatgagtgagca

SEQ ID NO: 6316 - DNA, 23 bp, Artificial Sequence
  Synthetic oligonucleotide
ggcagcgtccttctgagtgagca

SEQ ID NO: 6317 - DNA, 23 bp, Artificial Sequence
  Synthetic oligonucleotide
agcagtgtcgtgaagagtcagga

SEQ ID NO: 6318 - DNA, 24 bp, Artificial Sequence
  Synthetic oligonucleotide
agcagcttccggggagagagagga

SEQ ID NO: 6319 - DNA, 23 bp, Artificial Sequence
  Synthetic oligonucleotide
agcagctgcggaccgagtgagga

SEQ ID NO: 6320 - DNA, 23 bp, Artificial Sequence
  Synthetic oligonucleotide
agcagtggcattaagagtgagga

SEQ ID NO: 6321 - DNA, 23 bp, Artificial Sequence
  Synthetic oligonucleotide
agcagcatgcacatgagtgagga

SEQ ID NO: 6322 - DNA, 23 bp, Artificial Sequence
  Synthetic oligonucleotide
agcagcatgaccaagagtgagga

SEQ ID NO: 6323 - DNA, 24 bp, Artificial Sequence
  Synthetic oligonucleotide
accagggtctgtggggagtgagga

SEQ ID NO: 6324 - DNA, 24 bp, Artificial Sequence
  Synthetic oligonucleotide
agcagcatgaaaagggagtgagga

SEQ ID NO: 6325 - DNA, 23 bp, Artificial Sequence
  Synthetic oligonucleotide
agcagggtgatggagagtgagga

SEQ ID NO: 6326 - DNA, 23 bp, Artificial Sequence
  Synthetic oligonucleotide
agcagtgaccgaaggagtgagga

SEQ ID NO: 6327 - DNA, 23 bp, Artificial Sequence
  Synthetic oligonucleotide
agcagattcctcaggagtgagga

SEQ ID NO: 6328 - DNA, 23 bp, Artificial Sequence
  Synthetic oligonucleotide
atcagcgtggccatgagtgagga

SEQ ID NO: 6329 - DNA, 24 bp, Artificial Sequence
  Synthetic oligonucleotide
agcaggggcaagagagagtgagga

SEQ ID NO: 6330 - DNA, 24 bp, Artificial Sequence
  Synthetic oligonucleotide
agcgccgtccacagggagtgagga

SEQ ID NO: 6331 - DNA, 23 bp, Artificial Sequence
  Synthetic oligonucleotide
agcagcgtcccctggagtggcca

SEQ ID NO: 6332 - DNA, 24 bp, Artificial Sequence
  Synthetic oligonucleotide
agcagcgtccagtgggagtgggcc

SEQ ID NO: 6333 - DNA, 24 bp, Artificial Sequence
  Synthetic oligonucleotide
agcagcgtccttcctcagtgagac

SEQ ID NO: 6334 - DNA, 24 bp, Artificial Sequence
  Synthetic oligonucleotide
agcagcggcggcggggagggaggc

SEQ ID NO: 6335 - DNA, 24 bp, Artificial Sequence
  Synthetic oligonucleotide
agcagagtctgttgagagtgagac

SEQ ID NO: 6336 - DNA, 23 bp, Artificial Sequence
  Synthetic oligonucleotide
tgcagcgtcagaaggtgtgaggc

SEQ ID NO: 6337 - DNA, 23 bp, Artificial Sequence
  Synthetic oligonucleotide
agcagcgtgcctctgggtgaggc

SEQ ID NO: 6338 - DNA, 24 bp, Artificial Sequence
  Synthetic oligonucleotide
agcagcttccatctggagtgagtc

SEQ ID NO: 6339 - DNA, 24 bp, Artificial Sequence
  Synthetic oligonucleotide
agcagcatctgctcttagtgaggc

SEQ ID NO: 6340 - DNA, 23 bp, Artificial Sequence
  Synthetic oligonucleotide
agcaacgtcctgcagagggagaa

SEQ ID NO: 6341 - DNA, 23 bp, Artificial Sequence
  Synthetic oligonucleotide
agcagcggcccgcagagggaggc

SEQ ID NO: 6342 - DNA, 23 bp, Artificial Sequence
  Synthetic oligonucleotide
agcaacgtcagcaacagtgagaa

SEQ ID NO: 6343 - DNA, 23 bp, Artificial Sequence
  Synthetic oligonucleotide
agtagcgtctcgaagagagaggc

SEQ ID NO: 6344 - DNA, 23 bp, Artificial Sequence
  Synthetic oligonucleotide
agcagcgttttcaggagggaggg

SEQ ID NO: 6345 - DNA, 23 bp, Artificial Sequence
  Synthetic oligonucleotide
agcagcggcaccctgggtgaggc

SEQ ID NO: 6346 - DNA, 24 bp, Artificial Sequence
  Synthetic oligonucleotide
agcaaggtcaactcagagtgagaa

SEQ ID NO: 6347 - DNA, 24 bp, Artificial Sequence
  Synthetic oligonucleotide
agcatggtcagtttctagtgagga

SEQ ID NO: 6348 - DNA, 24 bp, Artificial Sequence
  Synthetic oligonucleotide
agtagggtcacgccagagtgaggc

SEQ ID NO: 6349 - DNA, 23 bp, Artificial Sequence
  Synthetic oligonucleotide
atcagggtcctgttgagtgaggg

SEQ ID NO: 6350 - DNA, 24 bp, Artificial Sequence
  Synthetic oligonucleotide
agcatggtctttttctagtgagga

SEQ ID NO: 6351 - DNA, 24 bp, Artificial Sequence
  Synthetic oligonucleotide
agcagggtaagaggggagtgaggg

SEQ ID NO: 6352 - DNA, 24 bp, Artificial Sequence
  Synthetic oligonucleotide
ggcaacgtcaactcagagtgagaa

SEQ ID NO: 6353 - DNA, 24 bp, Artificial Sequence
  Synthetic oligonucleotide
gccagcgtcttgggtgagtgaggt

SEQ ID NO: 6354 - DNA, 23 bp, Artificial Sequence
  Synthetic oligonucleotide
agcagctttctgctgagtgaggc

SEQ ID NO: 6355 - DNA, 23 bp, Artificial Sequence
  Synthetic oligonucleotide
agcagtggctgcgggagtgaggc

SEQ ID NO: 6356 - DNA, 23 bp, Artificial Sequence
  Synthetic oligonucleotide
ggcagcatctgggcgagtgaggc

SEQ ID NO: 6357 - DNA, 23 bp, Artificial Sequence
  Synthetic oligonucleotide
ggcagcatctgaatgagtgaggc

SEQ ID NO: 6358 - DNA, 23 bp, Artificial Sequence
  Synthetic oligonucleotide
agcagtgtatgtgggagtgaggt

SEQ ID NO: 6359 - DNA, 23 bp, Artificial Sequence
  Synthetic oligonucleotide
aggagagtccctgggagtgaggc

SEQ ID NO: 6360 - DNA, 24 bp, Artificial Sequence
  Synthetic oligonucleotide
agcatggtcagattctagtgagga

SEQ ID NO: 6361 - DNA, 24 bp, Artificial Sequence
  Synthetic oligonucleotide
atcagggtcttgagggagtgaggt

SEQ ID NO: 6362 - DNA, 23 bp, Artificial Sequence
  Synthetic oligonucleotide
aacagcgtgctgtagagtgaggt

SEQ ID NO: 6363 - DNA, 23 bp, Artificial Sequence
  Synthetic oligonucleotide
agtagcttctgtgggagtgaggc

SEQ ID NO: 6364 - DNA, 23 bp, Artificial Sequence
  Synthetic oligonucleotide
agcaacttcttgatgagtgagaa

SEQ ID NO: 6365 - DNA, 24 bp, Artificial Sequence
  Synthetic oligonucleotide
agcatggtcaggttctagtgagga

SEQ ID NO: 6366 - DNA, 24 bp, Artificial Sequence
  Synthetic oligonucleotide
agaagtgtcagagtagagtgaggc

SEQ ID NO: 6367 - DNA, 23 bp, Artificial Sequence
  Synthetic oligonucleotide
aacagcggcatggggagtgaggc

SEQ ID NO: 6368 - DNA, 24 bp, Artificial Sequence
  Synthetic oligonucleotide
agcagtggcatctaggagtgaggc

SEQ ID NO: 6369 - DNA, 24 bp, Artificial Sequence
  Synthetic oligonucleotide
aaaagtgtcatataggagtgagga

SEQ ID NO: 6370 - DNA, 23 bp, Artificial Sequence
  Synthetic oligonucleotide
agcaatggctggatgagtgagga

SEQ ID NO: 6371 - DNA, 24 bp, Artificial Sequence
  Synthetic oligonucleotide
gccaccgtcggtgaggagtgagga

SEQ ID NO: 6372 - DNA, 24 bp, Artificial Sequence
  Synthetic oligonucleotide
aaaagtgtcagtagagagtgagga

SEQ ID NO: 6373 - DNA, 24 bp, Artificial Sequence
  Synthetic oligonucleotide
aacattgtctagtgggagtgagga

SEQ ID NO: 6374 - DNA, 24 bp, Artificial Sequence
  Synthetic oligonucleotide
aacattgtctagtgagagtgagga

SEQ ID NO: 6375 - DNA, 24 bp, Artificial Sequence
  Synthetic oligonucleotide
aacattgtctagtgggagtgagga

SEQ ID NO: 6376 - DNA, 24 bp, Artificial Sequence
  Synthetic oligonucleotide
aacattgtctagtgagagtgagga

SEQ ID NO: 6377 - DNA, 24 bp, Artificial Sequence
  Synthetic oligonucleotide
aacattgtctagtgggagtgagga

SEQ ID NO: 6378 - DNA, 24 bp, Artificial Sequence
  Synthetic oligonucleotide
aacattgtctagtgagagtgagga

SEQ ID NO: 6379 - DNA, 24 bp, Artificial Sequence
  Synthetic oligonucleotide
aacattgtctagtgggagtgagga

SEQ ID NO: 6380 - DNA, 24 bp, Artificial Sequence
  Synthetic oligonucleotide
aacattgtctagtgagagtgagga

SEQ ID NO: 6381 - DNA, 24 bp, Artificial Sequence
  Synthetic oligonucleotide
aacattgtctagtgggagtgagga

SEQ ID NO: 6382 - DNA, 24 bp, Artificial Sequence
  Synthetic oligonucleotide
aacattgtctagtgagagtgagga

SEQ ID NO: 6383 - DNA, 24 bp, Artificial Sequence
  Synthetic oligonucleotide
aacattgtctagtgggagtgagga

SEQ ID NO: 6384 - DNA, 24 bp, Artificial Sequence
  Synthetic oligonucleotide
aacattgtctagtgagagtgagga

SEQ ID NO: 6385 - DNA, 24 bp, Artificial Sequence
  Synthetic oligonucleotide
aacattgtctagtgggagtgagga

SEQ ID NO: 6386 - DNA, 24 bp, Artificial Sequence
  Synthetic oligonucleotide
aacattgtctagtgagagtgagga

SEQ ID NO: 6387 - DNA, 24 bp, Artificial Sequence
  Synthetic oligonucleotide
atcaacttcttcagggagtgagga

SEQ ID NO: 6388 - DNA, 23 bp, Artificial Sequence
  Synthetic oligonucleotide
agcatggtgattaagagtgagga

SEQ ID NO: 6389 - DNA, 23 bp, Artificial Sequence
  Synthetic oligonucleotide
agtagtctctggctgagtgaggt

SEQ ID NO: 6390 - DNA, 23 bp, Artificial Sequence
  Synthetic oligonucleotide
agcattgtttctcagagtgaggt

SEQ ID NO: 6391 - DNA, 23 bp, Artificial Sequence
  Synthetic oligonucleotide
agcaaggttaggctgagtgaggg

SEQ ID NO: 6392 - DNA, 24 bp, Artificial Sequence
  Synthetic oligonucleotide
agcagtcttccaccagagtgaggc

SEQ ID NO: 6393 - DNA, 23 bp, Artificial Sequence
  Synthetic oligonucleotide
agcattgtttgagtgagtgaggt

SEQ ID NO: 6394 - DNA, 24 bp, Artificial Sequence
  Synthetic oligonucleotide
agcagcgtccgcagcaagttagga

SEQ ID NO: 6395 - DNA, 24 bp, Artificial Sequence
  Synthetic oligonucleotide
agcagcgtcactacagaggcagga

SEQ ID NO: 6396 - DNA, 24 bp, Artificial Sequence
  Synthetic oligonucleotide
ggcagcgtctctctggggtgagga

SEQ ID NO: 6397 - DNA, 23 bp, Artificial Sequence
  Synthetic oligonucleotide
agcagagtcttgaagagtgagta

SEQ ID NO: 6398 - DNA, 23 bp, Artificial Sequence
  Synthetic oligonucleotide
agcagcatctatgccagtgagga

SEQ ID NO: 6399 - DNA, 23 bp, Artificial Sequence
  Synthetic oligonucleotide
agcagagtctggcagagagagga

SEQ ID NO: 6400 - DNA, 23 bp, Artificial Sequence
  Synthetic oligonucleotide
agcagtgtccctcagagtgtgga

SEQ ID NO: 6401 - DNA, 23 bp, Artificial Sequence
  Synthetic oligonucleotide
agcagcatcttggagtgtgagga

SEQ ID NO: 6402 - DNA, 23 bp, Artificial Sequence
  Synthetic oligonucleotide
agctgcgtcttctggagggagga

SEQ ID NO: 6403 - DNA, 24 bp, Artificial Sequence
  Synthetic oligonucleotide
agcagcttcagaagagaatgagga

SEQ ID NO: 6404 - DNA, 23 bp, Artificial Sequence
  Synthetic oligonucleotide
agcagggtcgaggggagggagga

SEQ ID NO: 6405 - DNA, 23 bp, Artificial Sequence
  Synthetic oligonucleotide
agcagggtctggtgcagtgagga

SEQ ID NO: 6406 - DNA, 23 bp, Artificial Sequence
  Synthetic oligonucleotide
agcagcatccatgtcagtgagga

SEQ ID NO: 6407 - DNA, 23 bp, Artificial Sequence
  Synthetic oligonucleotide
agcagagtcccaaggggtgagga

SEQ ID NO: 6408 - DNA, 23 bp, Artificial Sequence
  Synthetic oligonucleotide
agcagcctctgaacaagtgagga

SEQ ID NO: 6409 - DNA, 23 bp, Artificial Sequence
  Synthetic oligonucleotide
agcagcctctaggtaagtgagga

SEQ ID NO: 6410 - DNA, 24 bp, Artificial Sequence
  Synthetic oligonucleotide
agcagcttcagatttgagttagga

SEQ ID NO: 6411 - DNA, 23 bp, Artificial Sequence
  Synthetic oligonucleotide
agcagcctcacaggcagtgagga

SEQ ID NO: 6412 - DNA, 23 bp, Artificial Sequence
  Synthetic oligonucleotide
agcagcatcaacaccagtgagga

SEQ ID NO: 6413 - DNA, 24 bp, Artificial Sequence
  Synthetic oligonucleotide
agcagcgtgtcagctgtgtgagga

SEQ ID NO: 6414 - DNA, 23 bp, Artificial Sequence
  Synthetic oligonucleotide
agcagcatctatgccagtgagga

SEQ ID NO: 6415 - DNA, 24 bp, Artificial Sequence
  Synthetic oligonucleotide
agcagcatcaataataagtgagga

SEQ ID NO: 6416 - DNA, 23 bp, Artificial Sequence
  Synthetic oligonucleotide
agcagagtcacccagtgtgagga

SEQ ID NO: 6417 - DNA, 24 bp, Artificial Sequence
  Synthetic oligonucleotide
ggcagcgtctgggaggagttagga

SEQ ID NO: 6418 - DNA, 23 bp, Artificial Sequence
  Synthetic oligonucleotide
agcagcgccatcttgagcgagga

SEQ ID NO: 6419 - DNA, 23 bp, Artificial Sequence
  Synthetic oligonucleotide
agctgcgtcgtgagaagtgagga

SEQ ID NO: 6420 - DNA, 23 bp, Artificial Sequence
  Synthetic oligonucleotide
agcagggtcacacagggtgagga

SEQ ID NO: 6421 - DNA, 24 bp, Artificial Sequence
  Synthetic oligonucleotide
agcagagtcagagaggagagagga

SEQ ID NO: 6422 - DNA, 24 bp, Artificial Sequence
  Synthetic oligonucleotide
agcagagtcactgaccagtgagga

SEQ ID NO: 6423 - DNA, 23 bp, Artificial Sequence
  Synthetic oligonucleotide
agcagtgtctcccagagtgtgga

SEQ ID NO: 6424 - DNA, 24 bp, Artificial Sequence
  Synthetic oligonucleotide
agcagtgtctgagtagagtgtgga

SEQ ID NO: 6425 - DNA, 23 bp, Artificial Sequence
  Synthetic oligonucleotide
agcagcatcccggggagtgaaga

SEQ ID NO: 6426 - DNA, 24 bp, Artificial Sequence
  Synthetic oligonucleotide
aacagcgtcaaggcagagtgaaga

SEQ ID NO: 6427 - DNA, 23 bp, Artificial Sequence
  Synthetic oligonucleotide
agcagcgccatcttgagcgagga

SEQ ID NO: 6428 - DNA, 23 bp, Artificial Sequence
  Synthetic oligonucleotide
agcagcgccatcttgagcgagga

SEQ ID NO: 6429 - DNA, 23 bp, Artificial Sequence
  Synthetic oligonucleotide
agcagcgccatcttgagcgagga

SEQ ID NO: 6430 - DNA, 23 bp, Artificial Sequence
  Synthetic oligonucleotide
agcagcgccatcttgagcgagga

SEQ ID NO: 6431 - DNA, 23 bp, Artificial Sequence
  Synthetic oligonucleotide
agcagcgccatcttgagcgagga

SEQ ID NO: 6432 - DNA, 23 bp, Artificial Sequence
  Synthetic oligonucleotide
agcagcgccatcttgagcgagga

SEQ ID NO: 6433 - DNA, 23 bp, Artificial Sequence
  Synthetic oligonucleotide
agcagcgccatcttgagcgagga

SEQ ID NO: 6434 - DNA, 23 bp, Artificial Sequence
  Synthetic oligonucleotide
agcagcgccatcttgagcgagga

SEQ ID NO: 6435 - DNA, 23 bp, Artificial Sequence
  Synthetic oligonucleotide
agcagcatccatgtcagtgagga

SEQ ID NO: 6436 - DNA, 24 bp, Artificial Sequence
  Synthetic oligonucleotide
agcagagtcagggaggagtgaaga

SEQ ID NO: 6437 - DNA, 24 bp, Artificial Sequence
  Synthetic oligonucleotide
agcagcctcatggtcaagtgagga

SEQ ID NO: 6438 - DNA, 24 bp, Artificial Sequence
  Synthetic oligonucleotide
agcagcatcgtgagtgagtgtgga

SEQ ID NO: 6439 - DNA, 24 bp, Artificial Sequence
  Synthetic oligonucleotide
agcagtgtctagcacgaatgagga

SEQ ID NO: 6440 - DNA, 24 bp, Artificial Sequence
  Synthetic oligonucleotide
agcagagtcacagaagagagagga

SEQ ID NO: 6441 - DNA, 23 bp, Artificial Sequence
  Synthetic oligonucleotide
agcagcgtggttaagagtcagga

SEQ ID NO: 6442 - DNA, 24 bp, Artificial Sequence
  Synthetic oligonucleotide
accagcgtctggtgagagtgggga

SEQ ID NO: 6443 - DNA, 23 bp, Artificial Sequence
  Synthetic oligonucleotide
agcagtgtcttgctgagagagga

SEQ ID NO: 6444 - DNA, 24 bp, Artificial Sequence
  Synthetic oligonucleotide
agcagcgacctgggcgagtgagaa

SEQ ID NO: 6445 - DNA, 24 bp, Artificial Sequence
  Synthetic oligonucleotide
agcagtgtctgccgtgagtgggga

SEQ ID NO: 6446 - DNA, 23 bp, Artificial Sequence
  Synthetic oligonucleotide
agcagcgtaatacacagtgagga

SEQ ID NO: 6447 - DNA, 24 bp, Artificial Sequence
  Synthetic oligonucleotide
agcagcctctagagaaagtgagga

SEQ ID NO: 6448 - DNA, 24 bp, Artificial Sequence
  Synthetic oligonucleotide
agcagagtcacgggtgtgtgagga

SEQ ID NO: 6449 - DNA, 23 bp, Artificial Sequence
  Synthetic oligonucleotide
tgcagcgtcatcaagagtgtgga

SEQ ID NO: 6450 - DNA, 24 bp, Artificial Sequence
  Synthetic oligonucleotide
agcagggaccaggtggagtgagga

SEQ ID NO: 6451 - DNA, 24 bp, Artificial Sequence
  Synthetic oligonucleotide
agcaggctctaaaatgagtgagga

SEQ ID NO: 6452 - DNA, 23 bp, Artificial Sequence
  Synthetic oligonucleotide
agcagcctaggaatgagtgagga

SEQ ID NO: 6453 - DNA, 24 bp, Artificial Sequence
  Synthetic oligonucleotide
agcatcctccaggaggagtgagga

SEQ ID NO: 6454 - DNA, 24 bp, Artificial Sequence
  Synthetic oligonucleotide
agcagagtactcagtgagtgagga

SEQ ID NO: 6455 - DNA, 23 bp, Artificial Sequence
  Synthetic oligonucleotide
agcagggtagaagagagtgagga

SEQ ID NO: 6456 - DNA, 24 bp, Artificial Sequence
  Synthetic oligonucleotide
agcagagacctgagggagtgagga

SEQ ID NO: 6457 - DNA, 23 bp, Artificial Sequence
  Synthetic oligonucleotide
agcagagtgggcaagagtgagga

SEQ ID NO: 6458 - DNA, 24 bp, Artificial Sequence
  Synthetic oligonucleotide
agctgcctcggtggggagtgagga

SEQ ID NO: 6459 - DNA, 24 bp, Artificial Sequence
  Synthetic oligonucleotide
aggagggtcctggatgagtgagga

SEQ ID NO: 6460 - DNA, 24 bp, Artificial Sequence
  Synthetic oligonucleotide
agcagactccttgatgagtgagga

SEQ ID NO: 6461 - DNA, 23 bp, Artificial Sequence
  Synthetic oligonucleotide
agcagagtatttgggagtgagga

SEQ ID NO: 6462 - DNA, 23 bp, Artificial Sequence
  Synthetic oligonucleotide
agcagagttgccaggagtgagga

SEQ ID NO: 6463 - DNA, 24 bp, Artificial Sequence
  Synthetic oligonucleotide
agcagcaccaaaatggagtgagga

SEQ ID NO: 6464 - DNA, 24 bp, Artificial Sequence
  Synthetic oligonucleotide
agcaggatcaggttagagtgagga

SEQ ID NO: 6465 - DNA, 24 bp, Artificial Sequence
  Synthetic oligonucleotide
tgcagcatccttcaggagtgagga

SEQ ID NO: 6466 - DNA, 23 bp, Artificial Sequence
  Synthetic oligonucleotide
agcagagtgtggtggagtgagga

SEQ ID NO: 6467 - DNA, 23 bp, Artificial Sequence
  Synthetic oligonucleotide
agcagtgcctaccagagtgagga

SEQ ID NO: 6468 - DNA, 23 bp, Artificial Sequence
  Synthetic oligonucleotide
agcagagtacccatgagtgagga

SEQ ID NO: 6469 - DNA, 24 bp, Artificial Sequence
  Synthetic oligonucleotide
agcagagtgaaaggagagtgagga

SEQ ID NO: 6470 - DNA, 24 bp, Artificial Sequence
  Synthetic oligonucleotide
agcaggatcaagaaagagtgagga

SEQ ID NO: 6471 - DNA, 24 bp, Artificial Sequence
  Synthetic oligonucleotide
agcagcttgtgtcatgagtgagga

SEQ ID NO: 6472 - DNA, 24 bp, Artificial Sequence
  Synthetic oligonucleotide
agcagagtaggttgtgagtgagga

SEQ ID NO: 6473 - DNA, 24 bp, Artificial Sequence
  Synthetic oligonucleotide
agcagcgtctgcagtttgtgggga

SEQ ID NO: 6474 - DNA, 24 bp, Artificial Sequence
  Synthetic oligonucleotide
agcagcgtcaggggattgtgggga

SEQ ID NO: 6475 - DNA, 23 bp, Artificial Sequence
  Synthetic oligonucleotide
agcagcgtccaagagagttacaa

SEQ ID NO: 6476 - DNA, 23 bp, Artificial Sequence
  Synthetic oligonucleotide
agcagcgtcaaagtttgagagga

SEQ ID NO: 6477 - DNA, 24 bp, Artificial Sequence
  Synthetic oligonucleotide
agcagcgtcaggcttcagtgtgaa

SEQ ID NO: 6478 - DNA, 24 bp, Artificial Sequence
  Synthetic oligonucleotide
agcagcgtcaggcttcagtgtgaa

SEQ ID NO: 6479 - DNA, 23 bp, Artificial Sequence
  Synthetic oligonucleotide
agcagcgtctttttgagagaagg

SEQ ID NO: 6480 - DNA, 23 bp, Artificial Sequence
  Synthetic oligonucleotide
agcagcgtcggggagagttgggg

SEQ ID NO: 6481 - DNA, 23 bp, Artificial Sequence
  Synthetic oligonucleotide
agcagcgtctccaggaacgtgga

SEQ ID NO: 6482 - DNA, 24 bp, Artificial Sequence
  Synthetic oligonucleotide
agcagcgtccttggggagtttggg

SEQ ID NO: 6483 - DNA, 23 bp, Artificial Sequence
  Synthetic oligonucleotide
agcagcgtcgtcacaggggagga

SEQ ID NO: 6484 - DNA, 23 bp, Artificial Sequence
  Synthetic oligonucleotide
agcagcgtccaaaaggctgaggg

SEQ ID NO: 6485 - DNA, 23 bp, Artificial Sequence
  Synthetic oligonucleotide
agcagcgtccgtcgcagtggggc

SEQ ID NO: 6486 - DNA, 24 bp, Artificial Sequence
  Synthetic oligonucleotide
agcagcgtccgcactgagggggca

SEQ ID NO: 6487 - DNA, 23 bp, Artificial Sequence
  Synthetic oligonucleotide
agcagcgtctctgcgggagaggc

SEQ ID NO: 6488 - DNA, 23 bp, Artificial Sequence
  Synthetic oligonucleotide
agcagcgtcatcttgagtggagc

SEQ ID NO: 6489 - DNA, 23 bp, Artificial Sequence
  Synthetic oligonucleotide
agcagcgtcagcgacagagaggc

SEQ ID NO: 6490 - DNA, 23 bp, Artificial Sequence
  Synthetic oligonucleotide
agcagcgtctgtatgtgtcagaa

SEQ ID NO: 6491 - DNA, 24 bp, Artificial Sequence
  Synthetic oligonucleotide
agcagcgtcattagggcatgagca

SEQ ID NO: 6492 - DNA, 24 bp, Artificial Sequence
  Synthetic oligonucleotide
agcagcgtcgatggaaagggaaga

SEQ ID NO: 6493 - DNA, 23 bp, Artificial Sequence
  Synthetic oligonucleotide
agcagcgtcaggaagagttgtga

SEQ ID NO: 6494 - DNA, 24 bp, Artificial Sequence
  Synthetic oligonucleotide
agcagcgtctaccgtgagtgctca

SEQ ID NO: 6495 - DNA, 23 bp, Artificial Sequence
  Synthetic oligonucleotide
agcagcgtcagggtttgagagga

SEQ ID NO: 6496 - DNA, 24 bp, Artificial Sequence
  Synthetic oligonucleotide
agcagcgtcatgagtgtgtaatga

SEQ ID NO: 6497 - DNA, 24 bp, Artificial Sequence
  Synthetic oligonucleotide
agcagcgtctctttagagtgggtt

SEQ ID NO: 6498 - DNA, 23 bp, Artificial Sequence
  Synthetic oligonucleotide
agcagcgtcctgtggaggcagaa

SEQ ID NO: 6499 - DNA, 24 bp, Artificial Sequence
  Synthetic oligonucleotide
agcagcgtcaggcttcagtgtgaa

SEQ ID NO: 6500 - DNA, 24 bp, Artificial Sequence
  Synthetic oligonucleotide
agcagcgtcaggcttcagtgtgaa

SEQ ID NO: 6501 - DNA, 24 bp, Artificial Sequence
  Synthetic oligonucleotide
agcagcgtcaggcttcagtgtgaa

SEQ ID NO: 6502 - DNA, 24 bp, Artificial Sequence
  Synthetic oligonucleotide
agcagcgtcaggcttcagtgtgaa

SEQ ID NO: 6503 - DNA, 24 bp, Artificial Sequence
  Synthetic oligonucleotide
agcagcgtcaggcttcagtgtgaa

SEQ ID NO: 6504 - DNA, 24 bp, Artificial Sequence
  Synthetic oligonucleotide
agcagcgtcaggcttcagtgtgaa

SEQ ID NO: 6505 - DNA, 24 bp, Artificial Sequence
  Synthetic oligonucleotide
agcagcgtcaggcttcagtgtgaa

SEQ ID NO: 6506 - DNA, 23 bp, Artificial Sequence
  Synthetic oligonucleotide
agcagcgtcagggtttgagagga

SEQ ID NO: 6507 - DNA, 24 bp, Artificial Sequence
  Synthetic oligonucleotide
agcagcgtcacactctactgaggt

SEQ ID NO: 6508 - DNA, 24 bp, Artificial Sequence
  Synthetic oligonucleotide
agcagcgtcacatgccagcgaggt

SEQ ID NO: 6509 - DNA, 24 bp, Artificial Sequence
  Synthetic oligonucleotide
agcagcgtccatggtgacagaggt

SEQ ID NO: 6510 - DNA, 24 bp, Artificial Sequence
  Synthetic oligonucleotide
agcagcgtcttccctgagagagct

SEQ ID NO: 6511 - DNA, 23 bp, Artificial Sequence
  Synthetic oligonucleotide
agcagcgtccaggagaggaaggc

SEQ ID NO: 6512 - DNA, 23 bp, Artificial Sequence
  Synthetic oligonucleotide
agcagcgtcatacaggctgaggt

SEQ ID NO: 6513 - DNA, 23 bp, Artificial Sequence
  Synthetic oligonucleotide
agcagcgtctgcatgaaggaggt

SEQ ID NO: 6514 - DNA, 23 bp, Artificial Sequence
  Synthetic oligonucleotide
agcagcgtcccagtgagcgatgg

SEQ ID NO: 6515 - DNA, 23 bp, Artificial Sequence
  Synthetic oligonucleotide
agcagcgtcttgcaaagggagaa

SEQ ID NO: 6516 - DNA, 23 bp, Artificial Sequence
  Synthetic oligonucleotide
agcagcgtcagggtttgagagga

SEQ ID NO: 6517 - DNA, 23 bp, Artificial Sequence
  Synthetic oligonucleotide
agcagcgtccacgtgtgtgcggt

SEQ ID NO: 6518 - DNA, 24 bp, Artificial Sequence
  Synthetic oligonucleotide
agcagcgtcagcctctagagggga

SEQ ID NO: 6519 - DNA, 23 bp, Artificial Sequence
  Synthetic oligonucleotide
agcagcgtccgcaggaggtaggg

SEQ ID NO: 6520 - DNA, 23 bp, Artificial Sequence
  Synthetic oligonucleotide
agcagcgtccaagagtgttacga

SEQ ID NO: 6521 - DNA, 23 bp, Artificial Sequence
  Synthetic oligonucleotide
agcagcgtcctagcctgtgaggg

SEQ ID NO: 6522 - DNA, 24 bp, Artificial Sequence
  Synthetic oligonucleotide
agcagcgtcctcctggagggagag

SEQ ID NO: 6523 - DNA, 24 bp, Artificial Sequence
  Synthetic oligonucleotide
agcagcgtcagggaggaggggaga

SEQ ID NO: 6524 - DNA, 24 bp, Artificial Sequence
  Synthetic oligonucleotide
agcagcgtccccccgcagtgatgg

SEQ ID NO: 6525 - DNA, 24 bp, Artificial Sequence
  Synthetic oligonucleotide
agcagcgtctcctgagagagaagg

SEQ ID NO: 6526 - DNA, 24 bp, Artificial Sequence
  Synthetic oligonucleotide
agcagcgtctgtcctgagtccaga

SEQ ID NO: 6527 - DNA, 24 bp, Artificial Sequence
  Synthetic oligonucleotide
agcagcgtcaaggattagagagta

SEQ ID NO: 6528 - DNA, 24 bp, Artificial Sequence
  Synthetic oligonucleotide
agcagcgtctcctgagagagaagg

SEQ ID NO: 6529 - DNA, 23 bp, Artificial Sequence
  Synthetic oligonucleotide
agtagcgtcctaatgagtgtgaa

SEQ ID NO: 6530 - DNA, 24 bp, Artificial Sequence
  Synthetic oligonucleotide
agcagcttctccatggagtgagac

SEQ ID NO: 6531 - DNA, 23 bp, Artificial Sequence
  Synthetic oligonucleotide
agcagggtcggggagagggaggg

SEQ ID NO: 6532 - DNA, 24 bp, Artificial Sequence
  Synthetic oligonucleotide
agcagcatccagactcagtgaggt

SEQ ID NO: 6533 - DNA, 24 bp, Artificial Sequence
  Synthetic oligonucleotide
agcagggtcagctaagagggaggc

SEQ ID NO: 6534 - DNA, 23 bp, Artificial Sequence
  Synthetic oligonucleotide
agcagcggcagcgagagtgatgt

SEQ ID NO: 6535 - DNA, 23 bp, Artificial Sequence
  Synthetic oligonucleotide
ggcagcgtctgacggagtgagtg

SEQ ID NO: 6536 - DNA, 24 bp, Artificial Sequence
  Synthetic oligonucleotide
agcagtgtcaggtaggagagaggc

SEQ ID NO: 6537 - DNA, 24 bp, Artificial Sequence
  Synthetic oligonucleotide
agcagggtctgagtggagtaaggt

SEQ ID NO: 6538 - DNA, 24 bp, Artificial Sequence
  Synthetic oligonucleotide
agcagtgtcagctggtagtgagaa

SEQ ID NO: 6539 - DNA, 23 bp, Artificial Sequence
  Synthetic oligonucleotide
agcaccgtctgggggagggaaga

SEQ ID NO: 6540 - DNA, 24 bp, Artificial Sequence
  Synthetic oligonucleotide
agcagcatcagcatggagggaggc

SEQ ID NO: 6541 - DNA, 24 bp, Artificial Sequence
  Synthetic oligonucleotide
agcagcctcggtcaagagtgagag

SEQ ID NO: 6542 - DNA, 23 bp, Artificial Sequence
  Synthetic oligonucleotide
ggcagcgtcaataaaagtgaggg

SEQ ID NO: 6543 - DNA, 23 bp, Artificial Sequence
  Synthetic oligonucleotide
agcaacgtcggcagcagtgggga

SEQ ID NO: 6544 - DNA, 24 bp, Artificial Sequence
  Synthetic oligonucleotide
agcaacgtcagcaaagtctgagga

SEQ ID NO: 6545 - DNA, 24 bp, Artificial Sequence
  Synthetic oligonucleotide
agcagggtcagtgtctagtgagaa

SEQ ID NO: 6546 - DNA, 24 bp, Artificial Sequence
  Synthetic oligonucleotide
agcagggtcaggatggagtggggt

SEQ ID NO: 6547 - DNA, 24 bp, Artificial Sequence
  Synthetic oligonucleotide
agcagtgtcagtgaacagtgaggt

SEQ ID NO: 6548 - DNA, 24 bp, Artificial Sequence
  Synthetic oligonucleotide
agcagggtcagtgcctagtgaggg

SEQ ID NO: 6549 - DNA, 24 bp, Artificial Sequence
  Synthetic oligonucleotide
agcagcgtacggactgagtgagcc

SEQ ID NO: 6550 - DNA, 24 bp, Artificial Sequence
  Synthetic oligonucleotide
agcagcttccccagtaagtgagaa

SEQ ID NO: 6551 - DNA, 23 bp, Artificial Sequence
  Synthetic oligonucleotide
agcagcggcacctcgagagagaa

SEQ ID NO: 6552 - DNA, 23 bp, Artificial Sequence
  Synthetic oligonucleotide
agcagtgtcctcaccagtaagga

SEQ ID NO: 6553 - DNA, 23 bp, Artificial Sequence
  Synthetic oligonucleotide
agcagggtctgttagagtgagtg

SEQ ID NO: 6554 - DNA, 23 bp, Artificial Sequence
  Synthetic oligonucleotide
agcagcttcacctggagggaggg

SEQ ID NO: 6555 - DNA, 24 bp, Artificial Sequence
  Synthetic oligonucleotide
agcaccgtcatctaagggtgaggc

SEQ ID NO: 6556 - DNA, 23 bp, Artificial Sequence
  Synthetic oligonucleotide
agcatcgtcctgtggagcgaggg

SEQ ID NO: 6557 - DNA, 24 bp, Artificial Sequence
  Synthetic oligonucleotide
agcagggtccttactcagtgaggt

SEQ ID NO: 6558 - DNA, 23 bp, Artificial Sequence
  Synthetic oligonucleotide
agcagagtctgagagtgtgaggt

SEQ ID NO: 6559 - DNA, 24 bp, Artificial Sequence
  Synthetic oligonucleotide
agcagcgtgcagtgacagtgaggc

SEQ ID NO: 6560 - DNA, 24 bp, Artificial Sequence
  Synthetic oligonucleotide
agcaccgtcattggagagggagaa

SEQ ID NO: 6561 - DNA, 23 bp, Artificial Sequence
  Synthetic oligonucleotide
agcagcttcacctggagggaggg

SEQ ID NO: 6562 - DNA, 24 bp, Artificial Sequence
  Synthetic oligonucleotide
agcagagtcgctgcagagtgagcc

SEQ ID NO: 6563 - DNA, 23 bp, Artificial Sequence
  Synthetic oligonucleotide
agcagcttcacctggagggaggg

SEQ ID NO: 6564 - DNA, 23 bp, Artificial Sequence
  Synthetic oligonucleotide
agcagcttcacctggagggaggg

SEQ ID NO: 6565 - DNA, 23 bp, Artificial Sequence
  Synthetic oligonucleotide
agcagcttcacctggagggaggg

SEQ ID NO: 6566 - DNA, 23 bp, Artificial Sequence
  Synthetic oligonucleotide
agcagcttcacctggagggaggg

SEQ ID NO: 6567 - DNA, 23 bp, Artificial Sequence
  Synthetic oligonucleotide
agcagcttcacctggagggaggg

SEQ ID NO: 6568 - DNA, 23 bp, Artificial Sequence
  Synthetic oligonucleotide
agcagcttcacctggagggaggg

SEQ ID NO: 6569 - DNA, 23 bp, Artificial Sequence
  Synthetic oligonucleotide
agcagagtccttgggagggaggg

SEQ ID NO: 6570 - DNA, 23 bp, Artificial Sequence
  Synthetic oligonucleotide
agcagcttcacctggagggaggg

SEQ ID NO: 6571 - DNA, 24 bp, Artificial Sequence
  Synthetic oligonucleotide
agcagcgtatgcatacagtgaggg

SEQ ID NO: 6572 - DNA, 24 bp, Artificial Sequence
  Synthetic oligonucleotide
agcagtgtcaggctggtgtgagaa

SEQ ID NO: 6573 - DNA, 24 bp, Artificial Sequence
  Synthetic oligonucleotide
agcagagtcggcgtctagtgaggg

SEQ ID NO: 6574 - DNA, 24 bp, Artificial Sequence
  Synthetic oligonucleotide
agcagcgtgggccgggagggaggt

SEQ ID NO: 6575 - DNA, 23 bp, Artificial Sequence
  Synthetic oligonucleotide
ggcagcgtccgattcagtgaggg

SEQ ID NO: 6576 - DNA, 24 bp, Artificial Sequence
  Synthetic oligonucleotide
agcagcttcactgaagagggaggc

SEQ ID NO: 6577 - DNA, 23 bp, Artificial Sequence
  Synthetic oligonucleotide
atcagcgtctctgggagtggggc

SEQ ID NO: 6578 - DNA, 24 bp, Artificial Sequence
  Synthetic oligonucleotide
agcagcggcaggcgagagtgacaa

SEQ ID NO: 6579 - DNA, 23 bp, Artificial Sequence
  Synthetic oligonucleotide
agcagcttcaacgtgagtgatgt

SEQ ID NO: 6580 - DNA, 23 bp, Artificial Sequence
  Synthetic oligonucleotide
agcagcttcctggggagtgagtt

SEQ ID NO: 6581 - DNA, 23 bp, Artificial Sequence
  Synthetic oligonucleotide
agcagcatctcgtggagggaggc

SEQ ID NO: 6582 - DNA, 23 bp, Artificial Sequence
  Synthetic oligonucleotide
agcagagtcttcaggagagaggc

SEQ ID NO: 6583 - DNA, 24 bp, Artificial Sequence
  Synthetic oligonucleotide
agcagggtcaagttccagtgaggg

SEQ ID NO: 6584 - DNA, 24 bp, Artificial Sequence
  Synthetic oligonucleotide
agcagagtcagtcttgagtgagtt

SEQ ID NO: 6585 - DNA, 24 bp, Artificial Sequence
  Synthetic oligonucleotide
agcagagtcagacttgagtgagtt

SEQ ID NO: 6586 - DNA, 23 bp, Artificial Sequence
  Synthetic oligonucleotide
tgcagcgtccagatgagggaggt

SEQ ID NO: 6587 - DNA, 23 bp, Artificial Sequence
  Synthetic oligonucleotide
agcatcgtcagaatgggtgaggg

SEQ ID NO: 6588 - DNA, 24 bp, Artificial Sequence
  Synthetic oligonucleotide
agcagtgtccagctccagtgaggc

SEQ ID NO: 6589 - DNA, 24 bp, Artificial Sequence
  Synthetic oligonucleotide
agcagcttctaaaaggagagaggt

SEQ ID NO: 6590 - DNA, 24 bp, Artificial Sequence
  Synthetic oligonucleotide
agcagggtccatgaggagtgagcc

SEQ ID NO: 6591 - DNA, 24 bp, Artificial Sequence
  Synthetic oligonucleotide
agcagtgtcaccacagagtgaagg

SEQ ID NO: 6592 - DNA, 24 bp, Artificial Sequence
  Synthetic oligonucleotide
agcagggtcaggttttagtgaggg

SEQ ID NO: 6593 - DNA, 24 bp, Artificial Sequence
  Synthetic oligonucleotide
agcagcatcaatgtctagtgaggg

SEQ ID NO: 6594 - DNA, 24 bp, Artificial Sequence
  Synthetic oligonucleotide
agcagtgtcccgcacgaggaagga

SEQ ID NO: 6595 - DNA, 24 bp, Artificial Sequence
  Synthetic oligonucleotide
agcagcttcttgtgagagagaggt

SEQ ID NO: 6596 - DNA, 24 bp, Artificial Sequence
  Synthetic oligonucleotide
agcagagtcctaagcgggtgaggg

SEQ ID NO: 6597 - DNA, 23 bp, Artificial Sequence
  Synthetic oligonucleotide
agcagtgtcaagtagagtgaagg

SEQ ID NO: 6598 - DNA, 24 bp, Artificial Sequence
  Synthetic oligonucleotide
agcatcgtcaagttctggtgagga

SEQ ID NO: 6599 - DNA, 24 bp, Artificial Sequence
  Synthetic oligonucleotide
agcagggtccctgctgagagaggg

SEQ ID NO: 6600 - DNA, 24 bp, Artificial Sequence
  Synthetic oligonucleotide
agcagagtcaagtcagagagaggc

SEQ ID NO: 6601 - DNA, 23 bp, Artificial Sequence
  Synthetic oligonucleotide
agcagcggctgatggactgaggc

SEQ ID NO: 6602 - DNA, 24 bp, Artificial Sequence
  Synthetic oligonucleotide
agcagagtccagtgggtgtgaggc

SEQ ID NO: 6603 - DNA, 23 bp, Artificial Sequence
  Synthetic oligonucleotide
agcagcggctgatggactgaggc

SEQ ID NO: 6604 - DNA, 24 bp, Artificial Sequence
  Synthetic oligonucleotide
agcagcggcagccgagagagaggg

SEQ ID NO: 6605 - DNA, 23 bp, Artificial Sequence
  Synthetic oligonucleotide
agcagcggctgatggactgaggc

SEQ ID NO: 6606 - DNA, 23 bp, Artificial Sequence
  Synthetic oligonucleotide
agcagcggctgatggactgaggc

SEQ ID NO: 6607 - DNA, 23 bp, Artificial Sequence
  Synthetic oligonucleotide
agcagcggctgatggactgaggc

SEQ ID NO: 6608 - DNA, 23 bp, Artificial Sequence
  Synthetic oligonucleotide
agcagcggctgatggactgaggc

SEQ ID NO: 6609 - DNA, 23 bp, Artificial Sequence
  Synthetic oligonucleotide
agcagcggctgatggactgaggc

SEQ ID NO: 6610 - DNA, 24 bp, Artificial Sequence
  Synthetic oligonucleotide
agcagcggcagccgagagagaggg

SEQ ID NO: 6611 - DNA, 23 bp, Artificial Sequence
  Synthetic oligonucleotide
agcagcggctgatggactgaggc

SEQ ID NO: 6612 - DNA, 23 bp, Artificial Sequence
  Synthetic oligonucleotide
tgcagcgtcttgtttagtgaggc

SEQ ID NO: 6613 - DNA, 24 bp, Artificial Sequence
  Synthetic oligonucleotide
agcagtgtcaggctggtgtgagaa

SEQ ID NO: 6614 - DNA, 24 bp, Artificial Sequence
  Synthetic oligonucleotide
agcagcgtagagtgggaatgaggg

SEQ ID NO: 6615 - DNA, 24 bp, Artificial Sequence
  Synthetic oligonucleotide
agcatcgtcacaggagggtgaggt

SEQ ID NO: 6616 - DNA, 23 bp, Artificial Sequence
  Synthetic oligonucleotide
agcagcggcacccagaatgaggg

SEQ ID NO: 6617 - DNA, 24 bp, Artificial Sequence
  Synthetic oligonucleotide
agcagcgttatttcagagtgtggt

SEQ ID NO: 6618 - DNA, 24 bp, Artificial Sequence
  Synthetic oligonucleotide
agcagagtcgctccagagtgagcc

SEQ ID NO: 6619 - DNA, 24 bp, Artificial Sequence
  Synthetic oligonucleotide
agcagtgtcatctttgagtgggaa

SEQ ID NO: 6620 - DNA, 24 bp, Artificial Sequence
  Synthetic oligonucleotide
agcagcatctcctagcagtgaggg

SEQ ID NO: 6621 - DNA, 23 bp, Artificial Sequence
  Synthetic oligonucleotide
agcaacgtcagtgggactgaggg

SEQ ID NO: 6622 - DNA, 23 bp, Artificial Sequence
  Synthetic oligonucleotide
agcaccgtcatcttgagtgagct

SEQ ID NO: 6623 - DNA, 23 bp, Artificial Sequence
  Synthetic oligonucleotide
agcagggtcctgaggggagagga

SEQ ID NO: 6624 - DNA, 24 bp, Artificial Sequence
  Synthetic oligonucleotide
ggcagcgtcaggagagagtgatgt

SEQ ID NO: 6625 - DNA, 24 bp, Artificial Sequence
  Synthetic oligonucleotide
agcatcgtcggggaggagtgggaa

SEQ ID NO: 6626 - DNA, 24 bp, Artificial Sequence
  Synthetic oligonucleotide
agcagtgtctgtgctcagtgaggt

SEQ ID NO: 6627 - DNA, 24 bp, Artificial Sequence
  Synthetic oligonucleotide
agcagtgtcagtcctgagagagca

SEQ ID NO: 6628 - DNA, 24 bp, Artificial Sequence
  Synthetic oligonucleotide
agcagcgttgctttctagtgaggt

SEQ ID NO: 6629 - DNA, 24 bp, Artificial Sequence
  Synthetic oligonucleotide
agcagcggcgacagggagagaggg

SEQ ID NO: 6630 - DNA, 24 bp, Artificial Sequence
  Synthetic oligonucleotide
agcaccgtcctgaaacagtgagta

SEQ ID NO: 6631 - DNA, 24 bp, Artificial Sequence
  Synthetic oligonucleotide
agcagtgtctgctgggagggtgga

SEQ ID NO: 6632 - DNA, 24 bp, Artificial Sequence
  Synthetic oligonucleotide
agcagcgccctgtgggagggaggt

SEQ ID NO: 6633 - DNA, 23 bp, Artificial Sequence
  Synthetic oligonucleotide
agcagagtcagaaagagtaaggc

SEQ ID NO: 6634 - DNA, 24 bp, Artificial Sequence
  Synthetic oligonucleotide
agcagcttctctaaggagtggggg

SEQ ID NO: 6635 - DNA, 23 bp, Artificial Sequence
  Synthetic oligonucleotide
agcagcttcacctggagggaggg

SEQ ID NO: 6636 - DNA, 23 bp, Artificial Sequence
  Synthetic oligonucleotide
agcagcttcacctggagggaggg

SEQ ID NO: 6637 - DNA, 23 bp, Artificial Sequence
  Synthetic oligonucleotide
agcagcttcacctggagggaggg

SEQ ID NO: 6638 - DNA, 23 bp, Artificial Sequence
  Synthetic oligonucleotide
agcagcttcatctggagggaggg

SEQ ID NO: 6639 - DNA, 23 bp, Artificial Sequence
  Synthetic oligonucleotide
agcagcttcacctggagggaggg

SEQ ID NO: 6640 - DNA, 23 bp, Artificial Sequence
  Synthetic oligonucleotide
agcagcttcacctggagggaggg

SEQ ID NO: 6641 - DNA, 23 bp, Artificial Sequence
  Synthetic oligonucleotide
agcagcttcacctggagggaggg

SEQ ID NO: 6642 - DNA, 23 bp, Artificial Sequence
  Synthetic oligonucleotide
agcagcttcacctggagggaggg

SEQ ID NO: 6643 - DNA, 23 bp, Artificial Sequence
  Synthetic oligonucleotide
agcagcttcacctggagggaggg

SEQ ID NO: 6644 - DNA, 23 bp, Artificial Sequence
  Synthetic oligonucleotide
agcagcttcacctggagggaggg

SEQ ID NO: 6645 - DNA, 23 bp, Artificial Sequence
  Synthetic oligonucleotide
agcagcttcacctggagggaggg

SEQ ID NO: 6646 - DNA, 24 bp, Artificial Sequence
  Synthetic oligonucleotide
agcagcttcctgctccagtgaggg

SEQ ID NO: 6647 - DNA, 23 bp, Artificial Sequence
  Synthetic oligonucleotide
agcagcttcacctggagggaggg

SEQ ID NO: 6648 - DNA, 24 bp, Artificial Sequence
  Synthetic oligonucleotide
agcagagtcaagagggtgtgaggg

SEQ ID NO: 6649 - DNA, 24 bp, Artificial Sequence
  Synthetic oligonucleotide
agcagggtcctgaaggagggaggg

SEQ ID NO: 6650 - DNA, 24 bp, Artificial Sequence
  Synthetic oligonucleotide
agcagggtcagcccagagggaggc

SEQ ID NO: 6651 - DNA, 23 bp, Artificial Sequence
  Synthetic oligonucleotide
ggcagcgtcattttgagtggggg

SEQ ID NO: 6652 - DNA, 23 bp, Artificial Sequence
  Synthetic oligonucleotide
agcagcgtgtggcagagagaggg

SEQ ID NO: 6653 - DNA, 24 bp, Artificial Sequence
  Synthetic oligonucleotide
agcaccgtccccgaggtgggagga

SEQ ID NO: 6654 - DNA, 23 bp, Artificial Sequence
  Synthetic oligonucleotide
agcagcttcccatcgggtgaggg

SEQ ID NO: 6655 - DNA, 24 bp, Artificial Sequence
  Synthetic oligonucleotide
agcagcatctgtggacagtgaggt

SEQ ID NO: 6656 - DNA, 24 bp, Artificial Sequence
  Synthetic oligonucleotide
agcagcgtgctggatgagtgtggt

SEQ ID NO: 6657 - DNA, 24 bp, Artificial Sequence
  Synthetic oligonucleotide
agcagcggcaggcaccagtgaggg

SEQ ID NO: 6658 - DNA, 24 bp, Artificial Sequence
  Synthetic oligonucleotide
agcagggtcaggggtgagtggggt

SEQ ID NO: 6659 - DNA, 23 bp, Artificial Sequence
  Synthetic oligonucleotide
agcagcggcgaacagagcgggga

SEQ ID NO: 6660 - DNA, 24 bp, Artificial Sequence
  Synthetic oligonucleotide
agctgcgtctctgggaagtgaggg

SEQ ID NO: 6661 - DNA, 24 bp, Artificial Sequence
  Synthetic oligonucleotide
agcagggtcatgacagagagaggg

SEQ ID NO: 6662 - DNA, 23 bp, Artificial Sequence
  Synthetic oligonucleotide
agcagcatctggcagagtaaggg

SEQ ID NO: 6663 - DNA, 23 bp, Artificial Sequence
  Synthetic oligonucleotide
agcagtgtccacctgagttaggt

SEQ ID NO: 6664 - DNA, 23 bp, Artificial Sequence
  Synthetic oligonucleotide
agcagcgacggcgggtgtgaggc

SEQ ID NO: 6665 - DNA, 24 bp, Artificial Sequence
  Synthetic oligonucleotide
agcagggtcacactaaagtgaggc

SEQ ID NO: 6666 - DNA, 23 bp, Artificial Sequence
  Synthetic oligonucleotide
agctgtgtcatgacaagtgagga

SEQ ID NO: 6667 - DNA, 23 bp, Artificial Sequence
  Synthetic oligonucleotide
agctgggtcatgtgaagtgagga

SEQ ID NO: 6668 - DNA, 23 bp, Artificial Sequence
  Synthetic oligonucleotide
agctgggtcatgtgaagtgagga

SEQ ID NO: 6669 - DNA, 24 bp, Artificial Sequence
  Synthetic oligonucleotide
ggcagcggccggaaaaagtgagga

SEQ ID NO: 6670 - DNA, 23 bp, Artificial Sequence
  Synthetic oligonucleotide
agcatggtcaatgacagtgagga

SEQ ID NO: 6671 - DNA, 24 bp, Artificial Sequence
  Synthetic oligonucleotide
atcagcctcttgtaggagtgaggg

SEQ ID NO: 6672 - DNA, 23 bp, Artificial Sequence
  Synthetic oligonucleotide
agcatggtcatgaacagtgagga

SEQ ID NO: 6673 - DNA, 24 bp, Artificial Sequence
  Synthetic oligonucleotide
agcaggggcatgagagagtgaggt

SEQ ID NO: 6674 - DNA, 23 bp, Artificial Sequence
  Synthetic oligonucleotide
aacagcgtggcggagagtgaggg

SEQ ID NO: 6675 - DNA, 24 bp, Artificial Sequence
  Synthetic oligonucleotide
aacagagtccaggaagagtgaggt

SEQ ID NO: 6676 - DNA, 24 bp, Artificial Sequence
  Synthetic oligonucleotide
aacagcatcagctctgagtgaggc

SEQ ID NO: 6677 - DNA, 24 bp, Artificial Sequence
  Synthetic oligonucleotide
atcagtgtcagtgagcagtgagga

SEQ ID NO: 6678 - DNA, 23 bp, Artificial Sequence
  Synthetic oligonucleotide
agcagctgcatgatgagtgaggt

SEQ ID NO: 6679 - DNA, 23 bp, Artificial Sequence
  Synthetic oligonucleotide
agcagggttgatcagagggagga

SEQ ID NO: 6680 - DNA, 23 bp, Artificial Sequence
  Synthetic oligonucleotide
agcatagtccagattagtgagga

SEQ ID NO: 6681 - DNA, 23 bp, Artificial Sequence
  Synthetic oligonucleotide
agcagcaaccttaagagtgaggg

SEQ ID NO: 6682 - DNA, 23 bp, Artificial Sequence
  Synthetic oligonucleotide
agctacgtctaagggagagagga

SEQ ID NO: 6683 - DNA, 24 bp, Artificial Sequence
  Synthetic oligonucleotide
agcagcattggtcctgagtgaggt

SEQ ID NO: 6684 - DNA, 23 bp, Artificial Sequence
  Synthetic oligonucleotide
agcattgtcatgaagagggagga

SEQ ID NO: 6685 - DNA, 24 bp, Artificial Sequence
  Synthetic oligonucleotide
agcagcacctggcctgagtgaggg

SEQ ID NO: 6686 - DNA, 23 bp, Artificial Sequence
  Synthetic oligonucleotide
agcagggttgggcagagggagga

SEQ ID NO: 6687 - DNA, 24 bp, Artificial Sequence
  Synthetic oligonucleotide
agtagagtctgactaaagtgagga

SEQ ID NO: 6688 - DNA, 23 bp, Artificial Sequence
  Synthetic oligonucleotide
agcaacgtgagtgtgagcgagga

SEQ ID NO: 6689 - DNA, 23 bp, Artificial Sequence
  Synthetic oligonucleotide
agcaaggtcccactcagtgagga

SEQ ID NO: 6690 - DNA, 23 bp, Artificial Sequence
  Synthetic oligonucleotide
agcagccacaaggtgagtgaggg

SEQ ID NO: 6691 - DNA, 23 bp, Artificial Sequence
  Synthetic oligonucleotide
agcaatgtcagggaaagtgagga

SEQ ID NO: 6692 - DNA, 24 bp, Artificial Sequence
  Synthetic oligonucleotide
agcagctactccagagagtgaggt

SEQ ID NO: 6693 - DNA, 23 bp, Artificial Sequence
  Synthetic oligonucleotide
agcagctgcagcaggggtgagga

SEQ ID NO: 6694 - DNA, 23 bp, Artificial Sequence
  Synthetic oligonucleotide
agcaggggcagcatgagtgaggt

SEQ ID NO: 6695 - DNA, 24 bp, Artificial Sequence
  Synthetic oligonucleotide
agcaacgtgacctactagtgagga

SEQ ID NO: 6696 - DNA, 23 bp, Artificial Sequence
  Synthetic oligonucleotide
aacagcgtaagtacaagtgagga

SEQ ID NO: 6697 - DNA, 23 bp, Artificial Sequence
  Synthetic oligonucleotide
tgcaccgtcagtaacagtgagga

SEQ ID NO: 6698 - DNA, 24 bp, Artificial Sequence
  Synthetic oligonucleotide
agcagtgtgtcccaagagtgaggg

SEQ ID NO: 6699 - DNA, 24 bp, Artificial Sequence
  Synthetic oligonucleotide
agcagctgcaattatgagagagga

SEQ ID NO: 6700 - DNA, 24 bp, Artificial Sequence
  Synthetic oligonucleotide
agcaccttctagctagagtgagca

SEQ ID NO: 6701 - DNA, 23 bp, Artificial Sequence
  Synthetic oligonucleotide
agcaaggtcagaaggagtaagga

SEQ ID NO: 6702 - DNA, 24 bp, Artificial Sequence
  Synthetic oligonucleotide
agctgcgtgggagcagagtgaggc

SEQ ID NO: 6703 - DNA, 23 bp, Artificial Sequence
  Synthetic oligonucleotide
agcaaggtcctagtgagtgaaga

SEQ ID NO: 6704 - DNA, 23 bp, Artificial Sequence
  Synthetic oligonucleotide
agcagattcagaaggagtgaggg

SEQ ID NO: 6705 - DNA, 24 bp, Artificial Sequence
  Synthetic oligonucleotide
agcaaagtcattagagagtaagga

SEQ ID NO: 6706 - DNA, 23 bp, Artificial Sequence
  Synthetic oligonucleotide
tgcagggtcttcccgagtgaggg

SEQ ID NO: 6707 - DNA, 24 bp, Artificial Sequence
  Synthetic oligonucleotide
agcagaatcttctgggagtgaggt

SEQ ID NO: 6708 - DNA, 24 bp, Artificial Sequence
  Synthetic oligonucleotide
agctgagtccctagagagggagga

SEQ ID NO: 6709 - DNA, 24 bp, Artificial Sequence
  Synthetic oligonucleotide
agcattgtccagaaacagtgagga

SEQ ID NO: 6710 - DNA, 23 bp, Artificial Sequence
  Synthetic oligonucleotide
tgcagggtcccagcgagtgaggg

SEQ ID NO: 6711 - DNA, 24 bp, Artificial Sequence
  Synthetic oligonucleotide
agcaacttcatgtatgagtgtgga

SEQ ID NO: 6712 - DNA, 24 bp, Artificial Sequence
  Synthetic oligonucleotide
agcagctgcctgctggagtgaggg

SEQ ID NO: 6713 - DNA, 23 bp, Artificial Sequence
  Synthetic oligonucleotide
agcagggttggggagagggagga

SEQ ID NO: 6714 - DNA, 23 bp, Artificial Sequence
  Synthetic oligonucleotide
agcaaggtcactgagagtaagga

SEQ ID NO: 6715 - DNA, 23 bp, Artificial Sequence
  Synthetic oligonucleotide
agctgtgtcaaaggaagtgagga

SEQ ID NO: 6716 - DNA, 24 bp, Artificial Sequence
  Synthetic oligonucleotide
aacagcatcttaggggagtgaggg

SEQ ID NO: 6717 - DNA, 24 bp, Artificial Sequence
  Synthetic oligonucleotide
agaagcttctaggctgagtgaggc

SEQ ID NO: 6718 - DNA, 24 bp, Artificial Sequence
  Synthetic oligonucleotide
agcagagtttggggtgagtgagaa

SEQ ID NO: 6719 - DNA, 24 bp, Artificial Sequence
  Synthetic oligonucleotide
agcagagtttgctttgagtgagta

SEQ ID NO: 6720 - DNA, 24 bp, Artificial Sequence
  Synthetic oligonucleotide
aggagggtctgaagagagtgaggg

SEQ ID NO: 6721 - DNA, 24 bp, Artificial Sequence
  Synthetic oligonucleotide
agcaacttcagcaaagtgtgagga

SEQ ID NO: 6722 - DNA, 23 bp, Artificial Sequence
  Synthetic oligonucleotide
agcagctccctggagagtgaggg

SEQ ID NO: 6723 - DNA, 24 bp, Artificial Sequence
  Synthetic oligonucleotide
agcaaagtctgggagaagtgagga

SEQ ID NO: 6724 - DNA, 24 bp, Artificial Sequence
  Synthetic oligonucleotide
agcaacgtgacccctgagtgggga

SEQ ID NO: 6725 - DNA, 23 bp, Artificial Sequence
  Synthetic oligonucleotide
agcagggtgtataagagtgaggg

SEQ ID NO: 6726 - DNA, 24 bp, Artificial Sequence
  Synthetic oligonucleotide
agcaggttcttgggagagtgaggt

SEQ ID NO: 6727 - DNA, 23 bp, Artificial Sequence
  Synthetic oligonucleotide
agcagcttgtttctgagtgaggg

SEQ ID NO: 6728 - DNA, 24 bp, Artificial Sequence
  Synthetic oligonucleotide
agcagtgttgcattaaagtgagga

SEQ ID NO: 6729 - DNA, 24 bp, Artificial Sequence
  Synthetic oligonucleotide
agaggcgtctgagcagagtgaggg

SEQ ID NO: 6730 - DNA, 24 bp, Artificial Sequence
  Synthetic oligonucleotide
agcagtgacttaggaaagtgagga

SEQ ID NO: 6731 - DNA, 23 bp, Artificial Sequence
  Synthetic oligonucleotide
agcaccttccgagtgagtgagca

SEQ ID NO: 6732 - DNA, 23 bp, Artificial Sequence
  Synthetic oligonucleotide
atcagtgtctcctccagtgagga

SEQ ID NO: 6733 - DNA, 23 bp, Artificial Sequence
  Synthetic oligonucleotide
agcagcagcaggaagagtgaggc

SEQ ID NO: 6734 - DNA, 23 bp, Artificial Sequence
  Synthetic oligonucleotide
agcagtgacacctgaagtgagga

SEQ ID NO: 6735 - DNA, 24 bp, Artificial Sequence
  Synthetic oligonucleotide
agcagggttcacagggagggagga

SEQ ID NO: 6736 - DNA, 24 bp, Artificial Sequence
  Synthetic oligonucleotide
agctgcggcaggcccgagtgaggc

SEQ ID NO: 6737 - DNA, 23 bp, Artificial Sequence
  Synthetic oligonucleotide
agcaacatctgctacagtgagga

SEQ ID NO: 6738 - DNA, 23 bp, Artificial Sequence
  Synthetic oligonucleotide
agcaacgtataatctagtgagga

SEQ ID NO: 6739 - DNA, 24 bp, Artificial Sequence
  Synthetic oligonucleotide
agcaggatcgcctgtgagtgaggg

SEQ ID NO: 6740 - DNA, 24 bp, Artificial Sequence
  Synthetic oligonucleotide
agcagcaacatgggagagtgaggt

SEQ ID NO: 6741 - DNA, 24 bp, Artificial Sequence
  Synthetic oligonucleotide
agtagcggcttcacagagtgagaa

SEQ ID NO: 6742 - DNA, 23 bp, Artificial Sequence
  Synthetic oligonucleotide
agcagccccatcctgagtgaggg

SEQ ID NO: 6743 - DNA, 23 bp, Artificial Sequence
  Synthetic oligonucleotide
agcagctgccagaagagagagga

SEQ ID NO: 6744 - DNA, 23 bp, Artificial Sequence
  Synthetic oligonucleotide
agcaccgttgttagaagtgagga

SEQ ID NO: 6745 - DNA, 23 bp, Artificial Sequence
  Synthetic oligonucleotide
agcagggtggttaagagtgaggg

SEQ ID NO: 6746 - DNA, 24 bp, Artificial Sequence
  Synthetic oligonucleotide
agctgggtcttgggaaagtgagga

SEQ ID NO: 6747 - DNA, 23 bp, Artificial Sequence
  Synthetic oligonucleotide
accaccgtcgcggaaagtgagga

SEQ ID NO: 6748 - DNA, 23 bp, Artificial Sequence
  Synthetic oligonucleotide
agaagcttcagttggagtgaggt

SEQ ID NO: 6749 - DNA, 24 bp, Artificial Sequence
  Synthetic oligonucleotide
agcagaggcacctttgagtgaggt

SEQ ID NO: 6750 - DNA, 23 bp, Artificial Sequence
  Synthetic oligonucleotide
agcatcgttgagctcagtgagga

SEQ ID NO: 6751 - DNA, 23 bp, Artificial Sequence
  Synthetic oligonucleotide
agaagcgtgtgctggagtgaggc

SEQ ID NO: 6752 - DNA, 24 bp, Artificial Sequence
  Synthetic oligonucleotide
gacagcgtctgggaggtgtgagga

SEQ ID NO: 6753 - DNA, 24 bp, Artificial Sequence
  Synthetic oligonucleotide
agcagagacctgcatgagtgaggg

SEQ ID NO: 6754 - DNA, 24 bp, Artificial Sequence
  Synthetic oligonucleotide
agcaaagtcctaaggaagtgagga

SEQ ID NO: 6755 - DNA, 24 bp, Artificial Sequence
  Synthetic oligonucleotide
agcattgtctctagagaatgagga

SEQ ID NO: 6756 - DNA, 24 bp, Artificial Sequence
  Synthetic oligonucleotide
agcaaagtcttgagagagcgagga

SEQ ID NO: 6757 - DNA, 24 bp, Artificial Sequence
  Synthetic oligonucleotide
agcacagtccccgttgagagagga

SEQ ID NO: 6758 - DNA, 23 bp, Artificial Sequence
  Synthetic oligonucleotide
agcagcagcactgagagtgaggc

SEQ ID NO: 6759 - DNA, 24 bp, Artificial Sequence
  Synthetic oligonucleotide
agcagggtggggtgtgagtgaggt

SEQ ID NO: 6760 - DNA, 24 bp, Artificial Sequence
  Synthetic oligonucleotide
aggagcatcgcgcaggagtgaggc

SEQ ID NO: 6761 - DNA, 23 bp, Artificial Sequence
  Synthetic oligonucleotide
agctgggtcatgtgaagtgagga

SEQ ID NO: 6762 - DNA, 23 bp, Artificial Sequence
  Synthetic oligonucleotide
agctgtgtcatgacaagtgagga

SEQ ID NO: 6763 - DNA, 23 bp, Artificial Sequence
  Synthetic oligonucleotide
agctgtgtcatgacaagtgagga

SEQ ID NO: 6764 - DNA, 24 bp, Artificial Sequence
  Synthetic oligonucleotide
aggagcgtatcttctgagtgaggc

SEQ ID NO: 6765 - DNA, 23 bp, Artificial Sequence
  Synthetic oligonucleotide
agcagccacagccagagtgaggg

SEQ ID NO: 6766 - DNA, 24 bp, Artificial Sequence
  Synthetic oligonucleotide
agcagcatgtgcagggagtgaggc

SEQ ID NO: 6767 - DNA, 24 bp, Artificial Sequence
  Synthetic oligonucleotide
agcattgtcttttgagagtgagaa

SEQ ID NO: 6768 - DNA, 23 bp, Artificial Sequence
  Synthetic oligonucleotide
agcagcctggacgtgagtgaggt

SEQ ID NO: 6769 - DNA, 23 bp, Artificial Sequence
  Synthetic oligonucleotide
agcagctccagcgagagtgaggg

SEQ ID NO: 6770 - DNA, 24 bp, Artificial Sequence
  Synthetic oligonucleotide
agcagcagctagggagagtgaggc

SEQ ID NO: 6771 - DNA, 24 bp, Artificial Sequence
  Synthetic oligonucleotide
agcaacttcaatcaggagtgtgga

SEQ ID NO: 6772 - DNA, 23 bp, Artificial Sequence
  Synthetic oligonucleotide
agcagagtagctttgagtgaggg

SEQ ID NO: 6773 - DNA, 23 bp, Artificial Sequence
  Synthetic oligonucleotide
agcagccttgtgtggagtgaggt

SEQ ID NO: 6774 - DNA, 23 bp, Artificial Sequence
  Synthetic oligonucleotide
agcagtgtttctgaaagtgagga

SEQ ID NO: 6775 - DNA, 23 bp, Artificial Sequence
  Synthetic oligonucleotide
agaagcatctgtatgagtgaggc

SEQ ID NO: 6776 - DNA, 24 bp, Artificial Sequence
  Synthetic oligonucleotide
agcagggtaaacaaagagtgaggt

SEQ ID NO: 6777 - DNA, 24 bp, Artificial Sequence
  Synthetic oligonucleotide
agcagagttaggagagagtgaggg

SEQ ID NO: 6778 - DNA, 24 bp, Artificial Sequence
  Synthetic oligonucleotide
agcagaggctggggagagtgaggg

SEQ ID NO: 6779 - DNA, 23 bp, Artificial Sequence
  Synthetic oligonucleotide
agcaacatcttatagagtgagca

SEQ ID NO: 6780 - DNA, 23 bp, Artificial Sequence
  Synthetic oligonucleotide
agcagagtatgtcagagtgaggt

SEQ ID NO: 6781 - DNA, 23 bp, Artificial Sequence
  Synthetic oligonucleotide
agcatcgttgagctgagtgaaga

SEQ ID NO: 6782 - DNA, 24 bp, Artificial Sequence
  Synthetic oligonucleotide
agaagcttccagaatgagtgaggc

SEQ ID NO: 6783 - DNA, 24 bp, Artificial Sequence
  Synthetic oligonucleotide
atcagcggcagatggcagtgagga

SEQ ID NO: 6784 - DNA, 23 bp, Artificial Sequence
  Synthetic oligonucleotide
agcagaatctctgggagtgaggc

SEQ ID NO: 6785 - DNA, 23 bp, Artificial Sequence
  Synthetic oligonucleotide
agctacgtcaccttgagggagga

SEQ ID NO: 6786 - DNA, 23 bp, Artificial Sequence
  Synthetic oligonucleotide
agcaatgtcaacaagagtgagaa

SEQ ID NO: 6787 - DNA, 24 bp, Artificial Sequence
  Synthetic oligonucleotide
agcattgtcatggtggagggagga

SEQ ID NO: 6788 - DNA, 23 bp, Artificial Sequence
  Synthetic oligonucleotide
agcaccgccgggaaaagtgagga

SEQ ID NO: 6789 - DNA, 24 bp, Artificial Sequence
  Synthetic oligonucleotide
agcacggtcgggtactagtgagga

SEQ ID NO: 6790 - DNA, 23 bp, Artificial Sequence
  Synthetic oligonucleotide
agcaacatctatatgagtgagca

SEQ ID NO: 6791 - DNA, 23 bp, Artificial Sequence
  Synthetic oligonucleotide
agcagggttggagtgagggagga

SEQ ID NO: 6792 - DNA, 24 bp, Artificial Sequence
  Synthetic oligonucleotide
agcagctgcagcaccgagtgaggg

SEQ ID NO: 6793 - DNA, 24 bp, Artificial Sequence
  Synthetic oligonucleotide
agcagtgtgtgggaggagtgaggg

SEQ ID NO: 6794 - DNA, 23 bp, Artificial Sequence
  Synthetic oligonucleotide
aacagagtctggttgagtgaggc

SEQ ID NO: 6795 - DNA, 23 bp, Artificial Sequence
  Synthetic oligonucleotide
ggcagtgtctggcaaagtgagga

SEQ ID NO: 6796 - DNA, 24 bp, Artificial Sequence
  Synthetic oligonucleotide
agcagtgtgtgggaggagtgaggg

SEQ ID NO: 6797 - DNA, 24 bp, Artificial Sequence
  Synthetic oligonucleotide
agcaaggtccagacaaagtgagga

SEQ ID NO: 6798 - DNA, 24 bp, Artificial Sequence
  Synthetic oligonucleotide
agcagtgtgtgggaggagtgaggg

SEQ ID NO: 6799 - DNA, 24 bp, Artificial Sequence
  Synthetic oligonucleotide
agcagtgtgtgggaggagtgaggg

SEQ ID NO: 6800 - DNA, 24 bp, Artificial Sequence
  Synthetic oligonucleotide
agcagtgtgtgggaggagtgaggg

SEQ ID NO: 6801 - DNA, 24 bp, Artificial Sequence
  Synthetic oligonucleotide
agcagtgtgtgggaggagtgaggg

SEQ ID NO: 6802 - DNA, 24 bp, Artificial Sequence
  Synthetic oligonucleotide
agcagtgtgtgggaggagtgaggg

SEQ ID NO: 6803 - DNA, 23 bp, Artificial Sequence
  Synthetic oligonucleotide
agcagcatgagagggagtgaggg

SEQ ID NO: 6804 - DNA, 23 bp, Artificial Sequence
  Synthetic oligonucleotide
agcactgtcattataagtgagga

SEQ ID NO: 6805 - DNA, 24 bp, Artificial Sequence
  Synthetic oligonucleotide
ggcagtgtctggaaaaagtgagga

SEQ ID NO: 6806 - DNA, 24 bp, Artificial Sequence
  Synthetic oligonucleotide
cacagcgtcaccctggagtgagaa

SEQ ID NO: 6807 - DNA, 24 bp, Artificial Sequence
  Synthetic oligonucleotide
agcaccttcctggctgagtgaggg

SEQ ID NO: 6808 - DNA, 24 bp, Artificial Sequence
  Synthetic oligonucleotide
agcacagtcccaaatgagtgagaa

SEQ ID NO: 6809 - DNA, 23 bp, Artificial Sequence
  Synthetic oligonucleotide
agcagattctggtagagtgaggg

SEQ ID NO: 6810 - DNA, 23 bp, Artificial Sequence
  Synthetic oligonucleotide
aggagggtcagcctgagtgaggg

SEQ ID NO: 6811 - DNA, 23 bp, Artificial Sequence
  Synthetic oligonucleotide
agcaacgtggcgggaagtgagga

SEQ ID NO: 6812 - DNA, 24 bp, Artificial Sequence
  Synthetic oligonucleotide
agcggcgttgagcttgagtgaggc

SEQ ID NO: 6813 - DNA, 23 bp, Artificial Sequence
  Synthetic oligonucleotide
aggagtgtctgggtgagtgaggt

SEQ ID NO: 6814 - DNA, 24 bp, Artificial Sequence
  Synthetic oligonucleotide
agctgcttcactgatgagtgaggc

SEQ ID NO: 6815 - DNA, 23 bp, Artificial Sequence
  Synthetic oligonucleotide
agcaacatccactgcagtgagga

SEQ ID NO: 6816 - DNA, 24 bp, Artificial Sequence
  Synthetic oligonucleotide
agcatagtcggacaatagtgagga

SEQ ID NO: 6817 - DNA, 24 bp, Artificial Sequence
  Synthetic oligonucleotide
agcaacatcaaacctgagagagga

SEQ ID NO: 6818 - DNA, 23 bp, Artificial Sequence
  Synthetic oligonucleotide
ggcagcgcccatctgagtgaggg

SEQ ID NO: 6819 - DNA, 23 bp, Artificial Sequence
  Synthetic oligonucleotide
agcagagtgtccaagagtgaggg

SEQ ID NO: 6820 - DNA, 24 bp, Artificial Sequence
  Synthetic oligonucleotide
agcaaagtcctagatgagggagga

SEQ ID NO: 6821 - DNA, 23 bp, Artificial Sequence
  Synthetic oligonucleotide
gacagcgtcacacacagtgagga

SEQ ID NO: 6822 - DNA, 23 bp, Artificial Sequence
  Synthetic oligonucleotide
agcggcggctggatgagtgaggg

SEQ ID NO: 6823 - DNA, 23 bp, Artificial Sequence
  Synthetic oligonucleotide
agccgcatcatcaagagtgaggc

SEQ ID NO: 6824 - DNA, 23 bp, Artificial Sequence
  Synthetic oligonucleotide
agcaaagtccccaggagggagga

SEQ ID NO: 6825 - DNA, 23 bp, Artificial Sequence
  Synthetic oligonucleotide
agcaggttctaagagagtgaggt

SEQ ID NO: 6826 - DNA, 23 bp, Artificial Sequence
  Synthetic oligonucleotide
agctgggtcacacgaagtgagga

SEQ ID NO: 6827 - DNA, 24 bp, Artificial Sequence
  Synthetic oligonucleotide
agcagagactgaatggagtgaggg

SEQ ID NO: 6828 - DNA, 24 bp, Artificial Sequence
  Synthetic oligonucleotide
agcagaggcttaaaggagtgaggg

SEQ ID NO: 6829 - DNA, 24 bp, Artificial Sequence
  Synthetic oligonucleotide
agctgagtctagccaaagtgagga

SEQ ID NO: 6830 - DNA, 23 bp, Artificial Sequence
  Synthetic oligonucleotide
agtagagtcttccagagtgagaa

SEQ ID NO: 6831 - DNA, 23 bp, Artificial Sequence
  Synthetic oligonucleotide
tgcagcgacaacaggagtgaggt

SEQ ID NO: 6832 - DNA, 23 bp, Artificial Sequence
  Synthetic oligonucleotide
agcagctgcctccggagagagga

SEQ ID NO: 6833 - DNA, 23 bp, Artificial Sequence
  Synthetic oligonucleotide
agcagcatggccctgagtgaggg

SEQ ID NO: 6834 - DNA, 23 bp, Artificial Sequence
  Synthetic oligonucleotide
agctgagtcccaaagagtgagaa

SEQ ID NO: 6835 - DNA, 23 bp, Artificial Sequence
  Synthetic oligonucleotide
agcaacatctgctacagtgagga

SEQ ID NO: 6836 - DNA, 23 bp, Artificial Sequence
  Synthetic oligonucleotide
agcaacatctgctacagtgagga

SEQ ID NO: 6837 - DNA, 23 bp, Artificial Sequence
  Synthetic oligonucleotide
accagcttcctgctgagtgaggt

SEQ ID NO: 6838 - DNA, 23 bp, Artificial Sequence
  Synthetic oligonucleotide
agcagcattattctgagtgaggg

SEQ ID NO: 6839 - DNA, 24 bp, Artificial Sequence
  Synthetic oligonucleotide
aggagtgtcgacaaggagtgaggg

SEQ ID NO: 6840 - DNA, 23 bp, Artificial Sequence
  Synthetic oligonucleotide
agaagcggctgcaggagtgaggg

SEQ ID NO: 6841 - DNA, 24 bp, Artificial Sequence
  Synthetic oligonucleotide
agcagccacagactagagtgaggc

SEQ ID NO: 6842 - DNA, 23 bp, Artificial Sequence
  Synthetic oligonucleotide
agcagcagcagcaggagtgaggc

SEQ ID NO: 6843 - DNA, 24 bp, Artificial Sequence
  Synthetic oligonucleotide
agcacagtccgcagggagggagga

SEQ ID NO: 6844 - DNA, 24 bp, Artificial Sequence
  Synthetic oligonucleotide
agctgcggcgaatgagagtgaggg

SEQ ID NO: 6845 - DNA, 23 bp, Artificial Sequence
  Synthetic oligonucleotide
agcaaggtcttatagggtgagga

SEQ ID NO: 6846 - DNA, 23 bp, Artificial Sequence
  Synthetic oligonucleotide
agcaccttctccatgagtgggga

SEQ ID NO: 6847 - DNA, 24 bp, Artificial Sequence
  Synthetic oligonucleotide
agcagcatgatcctggagtgaggc

SEQ ID NO: 6848 - DNA, 24 bp, Artificial Sequence
  Synthetic oligonucleotide
agcaaggtcaagagagagtgagca

SEQ ID NO: 6849 - DNA, 24 bp, Artificial Sequence
  Synthetic oligonucleotide
agcatggtcaaagctgagtgagaa

SEQ ID NO: 6850 - DNA, 24 bp, Artificial Sequence
  Synthetic oligonucleotide
agcagcatgatcttggagtgaggc

SEQ ID NO: 6851 - DNA, 24 bp, Artificial Sequence
  Synthetic oligonucleotide
agcagggtggggtgtgagtgaggt

SEQ ID NO: 6852 - DNA, 23 bp, Artificial Sequence
  Synthetic oligonucleotide
agaggtgtcgccatgagtgagga

SEQ ID NO: 6853 - DNA, 23 bp, Artificial Sequence
  Synthetic oligonucleotide
gtcagggtcatcaggagtgagga

SEQ ID NO: 6854 - DNA, 24 bp, Artificial Sequence
  Synthetic oligonucleotide
tgcactgtctctcccgagtgagga

SEQ ID NO: 6855 - DNA, 24 bp, Artificial Sequence
  Synthetic oligonucleotide
tgcggagtcgagggtgagtgagga

SEQ ID NO: 6856 - DNA, 24 bp, Artificial Sequence
  Synthetic oligonucleotide
agaaacgttcttgctgagtgagga

SEQ ID NO: 6857 - DNA, 23 bp, Artificial Sequence
  Synthetic oligonucleotide
aggagcaacatgctgagtgagga

SEQ ID NO: 6858 - DNA, 24 bp, Artificial Sequence
  Synthetic oligonucleotide
cgctgtgtccccggggagtgagga

SEQ ID NO: 6859 - DNA, 24 bp, Artificial Sequence
  Synthetic oligonucleotide
agcgtggtcactagggagtgagga

SEQ ID NO: 6860 - DNA, 23 bp, Artificial Sequence
  Synthetic oligonucleotide
agcaggtccttgaagagtgagga

SEQ ID NO: 6861 - DNA, 24 bp, Artificial Sequence
  Synthetic oligonucleotide
ggctgtgtcattcaggagtgagga

SEQ ID NO: 6862 - DNA, 24 bp, Artificial Sequence
  Synthetic oligonucleotide
tgcagagttagaggtgagtgagga

SEQ ID NO: 6863 - DNA, 24 bp, Artificial Sequence
  Synthetic oligonucleotide
atcatggtcagaaaagagtgagga

SEQ ID NO: 6864 - DNA, 24 bp, Artificial Sequence
  Synthetic oligonucleotide
agcaacgcggtgagggagtgagga

SEQ ID NO: 6865 - DNA, 23 bp, Artificial Sequence
  Synthetic oligonucleotide
tgaagtgtcagctcgagtgagga

SEQ ID NO: 6866 - DNA, 23 bp, Artificial Sequence
  Synthetic oligonucleotide
agcaactccgtcttgagtgagga

SEQ ID NO: 6867 - DNA, 24 bp, Artificial Sequence
  Synthetic oligonucleotide
agaaatgtcttccaggagtgagga

SEQ ID NO: 6868 - DNA, 24 bp, Artificial Sequence
  Synthetic oligonucleotide
ggcagggtatcacaggagtgagga

SEQ ID NO: 6869 - DNA, 23 bp, Artificial Sequence
  Synthetic oligonucleotide
agcaacatggagttgagtgagga

SEQ ID NO: 6870 - DNA, 24 bp, Artificial Sequence
  Synthetic oligonucleotide
gacagcgtggccagtgagtgagga

SEQ ID NO: 6871 - DNA, 23 bp, Artificial Sequence
  Synthetic oligonucleotide
ggctgagtcactctgagtgagga

SEQ ID NO: 6872 - DNA, 23 bp, Artificial Sequence
  Synthetic oligonucleotide
tgcagagttttgtggagtgagga

SEQ ID NO: 6873 - DNA, 24 bp, Artificial Sequence
  Synthetic oligonucleotide
agctgagtgctggatgagtgagga

SEQ ID NO: 6874 - DNA, 23 bp, Artificial Sequence
  Synthetic oligonucleotide
aactgagtctctgagagtgagga

SEQ ID NO: 6875 - DNA, 24 bp, Artificial Sequence
  Synthetic oligonucleotide
aacatagtctgtacagagtgagga

SEQ ID NO: 6876 - DNA, 23 bp, Artificial Sequence
  Synthetic oligonucleotide
agctgggtgacagtgagtgagga

SEQ ID NO: 6877 - DNA, 23 bp, Artificial Sequence
  Synthetic oligonucleotide
agcaccatatggctgagtgagga

SEQ ID NO: 6878 - DNA, 23 bp, Artificial Sequence
  Synthetic oligonucleotide
atcaggttccttctgagtgagga

SEQ ID NO: 6879 - DNA, 24 bp, Artificial Sequence
  Synthetic oligonucleotide
accacggtcaggtctgagtgagga

SEQ ID NO: 6880 - DNA, 24 bp, Artificial Sequence
  Synthetic oligonucleotide
accacggtcaggtctgagtgagga

SEQ ID NO: 6881 - DNA, 24 bp, Artificial Sequence
  Synthetic oligonucleotide
accacggtcaggtctgagtgagga

SEQ ID NO: 6882 - DNA, 24 bp, Artificial Sequence
  Synthetic oligonucleotide
accacggtcaggtctgagtgagga

SEQ ID NO: 6883 - DNA, 24 bp, Artificial Sequence
  Synthetic oligonucleotide
accatggtcaagtctgagtgagga

SEQ ID NO: 6884 - DNA, 23 bp, Artificial Sequence
  Synthetic oligonucleotide
agaaacttcctctcgagtgagga

SEQ ID NO: 6885 - DNA, 24 bp, Artificial Sequence
  Synthetic oligonucleotide
cacagcttctcacaggagtgagga

SEQ ID NO: 6886 - DNA, 23 bp, Artificial Sequence
  Synthetic oligonucleotide
atcatggtcttagagagtgagga

SEQ ID NO: 6887 - DNA, 23 bp, Artificial Sequence
  Synthetic oligonucleotide
agcagtgattgagggagtgagga

SEQ ID NO: 6888 - DNA, 23 bp, Artificial Sequence
  Synthetic oligonucleotide
accaaggtcacactgagtgagga

SEQ ID NO: 6889 - DNA, 24 bp, Artificial Sequence
  Synthetic oligonucleotide
agccccttcctagaggagtgagga

SEQ ID NO: 6890 - DNA, 24 bp, Artificial Sequence
  Synthetic oligonucleotide
ctcagtgtctaagcagagtgagga

SEQ ID NO: 6891 - DNA, 23 bp, Artificial Sequence
  Synthetic oligonucleotide
agttgcttcctgaggagtgagga

SEQ ID NO: 6892 - DNA, 23 bp, Artificial Sequence
  Synthetic oligonucleotide
aagagagtctgaaagagtgagga

SEQ ID NO: 6893 - DNA, 24 bp, Artificial Sequence
  Synthetic oligonucleotide
ggcagtgtggtcaccgagtgagga

SEQ ID NO: 6894 - DNA, 24 bp, Artificial Sequence
  Synthetic oligonucleotide
tgcagagttgggtcagagtgagga

SEQ ID NO: 6895 - DNA, 24 bp, Artificial Sequence
  Synthetic oligonucleotide
agcctcgttgccagagagtgagga

SEQ ID NO: 6896 - DNA, 24 bp, Artificial Sequence
  Synthetic oligonucleotide
atcatcttcaagtaagagtgagga

SEQ ID NO: 6897 - DNA, 24 bp, Artificial Sequence
  Synthetic oligonucleotide
agtagtgtgtgaagggagtgagga

SEQ ID NO: 6898 - DNA, 24 bp, Artificial Sequence
  Synthetic oligonucleotide
agcctcgtgtcctcagagtgagga

SEQ ID NO: 6899 - DNA, 24 bp, Artificial Sequence
  Synthetic oligonucleotide
aaaagcgtttgggaagagtgagga

SEQ ID NO: 6900 - DNA, 24 bp, Artificial Sequence
  Synthetic oligonucleotide
actagagtcccccaagagtgagga

SEQ ID NO: 6901 - DNA, 23 bp, Artificial Sequence
  Synthetic oligonucleotide
ggcggcggcgaagggagtgagga

SEQ ID NO: 6902 - DNA, 23 bp, Artificial Sequence
  Synthetic oligonucleotide
atgagagtcctggggagtgagga

SEQ ID NO: 6903 - DNA, 24 bp, Artificial Sequence
  Synthetic oligonucleotide
agcacagtggcctgagagtgagga

SEQ ID NO: 6904 - DNA, 24 bp, Artificial Sequence
  Synthetic oligonucleotide
tacagggtcctcggtgagtgagga

SEQ ID NO: 6905 - DNA, 23 bp, Artificial Sequence
  Synthetic oligonucleotide
agcagaggtgctgagagtgagga

SEQ ID NO: 6906 - DNA, 23 bp, Artificial Sequence
  Synthetic oligonucleotide
ggaagagtccaggggagtgagga

SEQ ID NO: 6907 - DNA, 23 bp, Artificial Sequence
  Synthetic oligonucleotide
ggaagagtccaggggagtgagga

SEQ ID NO: 6908 - DNA, 24 bp, Artificial Sequence
  Synthetic oligonucleotide
agtggggtctgttgggagtgagga

SEQ ID NO: 6909 - DNA, 24 bp, Artificial Sequence
  Synthetic oligonucleotide
atgagggtcactgaggagtgagga

SEQ ID NO: 6910 - DNA, 23 bp, Artificial Sequence
  Synthetic oligonucleotide
gtcagagtcctagggagtgagga

SEQ ID NO: 6911 - DNA, 24 bp, Artificial Sequence
  Synthetic oligonucleotide
gccagggtctgggaggagtgagga

SEQ ID NO: 6912 - DNA, 23 bp, Artificial Sequence
  Synthetic oligonucleotide
agcaactccatcttgagtgagga

SEQ ID NO: 6913 - DNA, 23 bp, Artificial Sequence
  Synthetic oligonucleotide
aggggagtcgacaggagtgagga

SEQ ID NO: 6914 - DNA, 23 bp, Artificial Sequence
  Synthetic oligonucleotide
gtcagggtcatcaggagtgagga

SEQ ID NO: 6915 - DNA, 23 bp, Artificial Sequence
  Synthetic oligonucleotide
gtcagggtcatcaggagtgagga

SEQ ID NO: 6916 - DNA, 23 bp, Artificial Sequence
  Synthetic oligonucleotide
agcatagtagttaagagtgagga

SEQ ID NO: 6917 - DNA, 23 bp, Artificial Sequence
  Synthetic oligonucleotide
gtcagagtccaaaagagtgagga

SEQ ID NO: 6918 - DNA, 23 bp, Artificial Sequence
  Synthetic oligonucleotide
ggcagtgttacaaagagtgagga

SEQ ID NO: 6919 - DNA, 23 bp, Artificial Sequence
  Synthetic oligonucleotide
gccatcgtcacccagagtgagga

SEQ ID NO: 6920 - DNA, 24 bp, Artificial Sequence
  Synthetic oligonucleotide
ctcagtgtcgagagagagtgagga

SEQ ID NO: 6921 - DNA, 24 bp, Artificial Sequence
  Synthetic oligonucleotide
ggaagagtcaagggagagtgagga

SEQ ID NO: 6922 - DNA, 24 bp, Artificial Sequence
  Synthetic oligonucleotide
agcaactccagaagagagtgagga

SEQ ID NO: 6923 - DNA, 24 bp, Artificial Sequence
  Synthetic oligonucleotide
agcctcggcggccctgagtgagga

SEQ ID NO: 6924 - DNA, 24 bp, Artificial Sequence
  Synthetic oligonucleotide
gacagggtcactttagagtgagga

SEQ ID NO: 6925 - DNA, 23 bp, Artificial Sequence
  Synthetic oligonucleotide
agaatagtcctggggagtgagga

SEQ ID NO: 6926 - DNA, 24 bp, Artificial Sequence
  Synthetic oligonucleotide
agtagagtagtaaaggagtgagga

SEQ ID NO: 6927 - DNA, 24 bp, Artificial Sequence
  Synthetic oligonucleotide
gggagggtcggtcaggagtgagga

SEQ ID NO: 6928 - DNA, 23 bp, Artificial Sequence
  Synthetic oligonucleotide
aacagggttatccagagtgagga

SEQ ID NO: 6929 - DNA, 23 bp, Artificial Sequence
  Synthetic oligonucleotide
gccagggtcacccagagtgagga

SEQ ID NO: 6930 - DNA, 24 bp, Artificial Sequence
  Synthetic oligonucleotide
ggaagagtcttacctgagtgagga

SEQ ID NO: 6931 - DNA, 24 bp, Artificial Sequence
  Synthetic oligonucleotide
agtggagtcaccgtagagtgagga

SEQ ID NO: 6932 - DNA, 24 bp, Artificial Sequence
  Synthetic oligonucleotide
gccagagtcacccttgagtgagga

SEQ ID NO: 6933 - DNA, 24 bp, Artificial Sequence
  Synthetic oligonucleotide
ggcagtgtaacttaagagtgagga

SEQ ID NO: 6934 - DNA, 23 bp, Artificial Sequence
  Synthetic oligonucleotide
ctcagtgtcgttgtgagtgagga

SEQ ID NO: 6935 - DNA, 24 bp, Artificial Sequence
  Synthetic oligonucleotide
agatgggtctacagagagtgagga

SEQ ID NO: 6936 - DNA, 24 bp, Artificial Sequence
  Synthetic oligonucleotide
gccagagtctgagtggagtgagga

SEQ ID NO: 6937 - DNA, 23 bp, Artificial Sequence
  Synthetic oligonucleotide
agtagggtttgaatgagtgagga

SEQ ID NO: 6938 - DNA, 24 bp, Artificial Sequence
  Synthetic oligonucleotide
cactgcgtccttggtgagtgagga

SEQ ID NO: 6939 - DNA, 24 bp, Artificial Sequence
  Synthetic oligonucleotide
aactgggtccctgaggagtgagga

SEQ ID NO: 6940 - DNA, 24 bp, Artificial Sequence
  Synthetic oligonucleotide
agtaacatcagtagtgagtgagga

SEQ ID NO: 6941 - DNA, 24 bp, Artificial Sequence
  Synthetic oligonucleotide
gacagagtccacagagagtgagga

SEQ ID NO: 6942 - DNA, 23 bp, Artificial Sequence
  Synthetic oligonucleotide
atcaggttccaatagagtgagga

SEQ ID NO: 6943 - DNA, 23 bp, Artificial Sequence
  Synthetic oligonucleotide
agcatggtagtggggagtgagga

SEQ ID NO: 6944 - DNA, 24 bp, Artificial Sequence
  Synthetic oligonucleotide
agcaactgcccttctgagtgagga

SEQ ID NO: 6945 - DNA, 24 bp, Artificial Sequence
  Synthetic oligonucleotide
ggctgagtcttgcaggagtgagga

SEQ ID NO: 6946 - DNA, 24 bp, Artificial Sequence
  Synthetic oligonucleotide
agcagcccagggggtgagtgagga

SEQ ID NO: 6947 - DNA, 23 bp, Artificial Sequence
  Synthetic oligonucleotide
agcaaagtgtcaatgagtgagga

SEQ ID NO: 6948 - DNA, 24 bp, Artificial Sequence
  Synthetic oligonucleotide
agaaaagtccacagggagtgagga

SEQ ID NO: 6949 - DNA, 23 bp, Artificial Sequence
  Synthetic oligonucleotide
aacaacttctcctggagtgagga

SEQ ID NO: 6950 - DNA, 24 bp, Artificial Sequence
  Synthetic oligonucleotide
tgcggagtccctggggagtgagga

SEQ ID NO: 6951 - DNA, 24 bp, Artificial Sequence
  Synthetic oligonucleotide
agaatggtctctgatgagtgagga

SEQ ID NO: 6952 - DNA, 24 bp, Artificial Sequence
  Synthetic oligonucleotide
agcagcagaacaactgagtgagga

SEQ ID NO: 6953 - DNA, 23 bp, Artificial Sequence
  Synthetic oligonucleotide
agcagcagatattggagtgagga

SEQ ID NO: 6954 - DNA, 24 bp, Artificial Sequence
  Synthetic oligonucleotide
agttgcttcttctaagagtgagga

SEQ ID NO: 6955 - DNA, 23 bp, Artificial Sequence
  Synthetic oligonucleotide
gacagggtcctggagagtgagga

SEQ ID NO: 6956 - DNA, 23 bp, Artificial Sequence
  Synthetic oligonucleotide
ggaagagtccgggggagtgagga

SEQ ID NO: 6957 - DNA, 23 bp, Artificial Sequence
  Synthetic oligonucleotide
ggaagagtccaaaggagtgagga

SEQ ID NO: 6958 - DNA, 24 bp, Artificial Sequence
  Synthetic oligonucleotide
aggggggtcaagagtgagtgagga

SEQ ID NO: 6959 - DNA, 23 bp, Artificial Sequence
  Synthetic oligonucleotide
aacaacttccatgtgagtgagga

SEQ ID NO: 6960 - DNA, 24 bp, Artificial Sequence
  Synthetic oligonucleotide
accaaggtcagcagggagtgagga

SEQ ID NO: 6961 - DNA, 24 bp, Artificial Sequence
  Synthetic oligonucleotide
ggccacgtcgcacaggagtgagga

SEQ ID NO: 6962 - DNA, 24 bp, Artificial Sequence
  Synthetic oligonucleotide
agcaaggttaggaaggagtgagga

SEQ ID NO: 6963 - DNA, 24 bp, Artificial Sequence
  Synthetic oligonucleotide
agtagggttggaggggagtgagga

SEQ ID NO: 6964 - DNA, 24 bp, Artificial Sequence
  Synthetic oligonucleotide
agcagcgtcacaaaatagcaaggt

SEQ ID NO: 6965 - DNA, 23 bp, Artificial Sequence
  Synthetic oligonucleotide
agcagcgtcaaggggagacaagt

SEQ ID NO: 6966 - DNA, 24 bp, Artificial Sequence
  Synthetic oligonucleotide
agcagcgtccgtcccgagaggcgc

SEQ ID NO: 6967 - DNA, 23 bp, Artificial Sequence
  Synthetic oligonucleotide
agcagcggcctagcgggtgagtc

SEQ ID NO: 6968 - DNA, 23 bp, Artificial Sequence
  Synthetic oligonucleotide
agcagcgttgctatgagaaaggt

SEQ ID NO: 6969 - DNA, 24 bp, Artificial Sequence
  Synthetic oligonucleotide
agcaacgtcatgtgctggggagga

SEQ ID NO: 6970 - DNA, 23 bp, Artificial Sequence
  Synthetic oligonucleotide
agcagcggccggagaagtgtggg

SEQ ID NO: 6971 - DNA, 23 bp, Artificial Sequence
  Synthetic oligonucleotide
agcaacgtctgtttgtgtaaggc

SEQ ID NO: 6972 - DNA, 23 bp, Artificial Sequence
  Synthetic oligonucleotide
agcaacgtcacctggagtcacgc

SEQ ID NO: 6973 - DNA, 24 bp, Artificial Sequence
  Synthetic oligonucleotide
agcagtgtcatgatggtgtgtgaa

SEQ ID NO: 6974 - DNA, 24 bp, Artificial Sequence
  Synthetic oligonucleotide
agcagcggccacatagtgtgtgaa

SEQ ID NO: 6975 - DNA, 24 bp, Artificial Sequence
  Synthetic oligonucleotide
agcaacgtccagtccaagtgtggc

SEQ ID NO: 6976 - DNA, 24 bp, Artificial Sequence
  Synthetic oligonucleotide
agcaacgtcggatgcaggtgagca

SEQ ID NO: 6977 - DNA, 24 bp, Artificial Sequence
  Synthetic oligonucleotide
atcagcgtccagatggtgtgagtc

SEQ ID NO: 6978 - DNA, 23 bp, Artificial Sequence
  Synthetic oligonucleotide
agcaacgtccttactagtgaata

SEQ ID NO: 6979 - DNA, 23 bp, Artificial Sequence
  Synthetic oligonucleotide
agcaacgtcgtgacgtgcgatga

SEQ ID NO: 6980 - DNA, 24 bp, Artificial Sequence
  Synthetic oligonucleotide
agcagtgtctgtctggagtgttgc

SEQ ID NO: 6981 - DNA, 24 bp, Artificial Sequence
  Synthetic oligonucleotide
agcagcgttgttttgatgtgaggc

SEQ ID NO: 6982 - DNA, 23 bp, Artificial Sequence
  Synthetic oligonucleotide
agcaacgtctgtgtgagtgacag

SEQ ID NO: 6983 - DNA, 23 bp, Artificial Sequence
  Synthetic oligonucleotide
agcaccgtctgccggtgtgcggt

SEQ ID NO: 6984 - DNA, 24 bp, Artificial Sequence
  Synthetic oligonucleotide
agcaacgtccagtccaagtgtggc

SEQ ID NO: 6985 - DNA, 24 bp, Artificial Sequence
  Synthetic oligonucleotide
agcattgtcttgtgggagtaaggc

SEQ ID NO: 6986 - DNA, 24 bp, Artificial Sequence
  Synthetic oligonucleotide
agcagcgatggggttgagtgagac

SEQ ID NO: 6987 - DNA, 24 bp, Artificial Sequence
  Synthetic oligonucleotide
agctgtgtcatccatgagtgagtc

SEQ ID NO: 6988 - DNA, 24 bp, Artificial Sequence
  Synthetic oligonucleotide
agcatggtcaagttctagtgaggg

SEQ ID NO: 6989 - DNA, 24 bp, Artificial Sequence
  Synthetic oligonucleotide
agcatggtcaagttctagtgaggg

SEQ ID NO: 6990 - DNA, 23 bp, Artificial Sequence
  Synthetic oligonucleotide
agcatcttcatatggagtgagag

SEQ ID NO: 6991 - DNA, 24 bp, Artificial Sequence
  Synthetic oligonucleotide
agcatggtcaggttctagtgaggg

SEQ ID NO: 6992 - DNA, 23 bp, Artificial Sequence
  Synthetic oligonucleotide
agcatagtcaaggggagtgagag

SEQ ID NO: 6993 - DNA, 24 bp, Artificial Sequence
  Synthetic oligonucleotide
agcatggtctctttctagtgaggg

SEQ ID NO: 6994 - DNA, 24 bp, Artificial Sequence
  Synthetic oligonucleotide
agcatggtcaggttctagtgaggg

SEQ ID NO: 6995 - DNA, 24 bp, Artificial Sequence
  Synthetic oligonucleotide
agcatagtctttattgagtgagag

SEQ ID NO: 6996 - DNA, 24 bp, Artificial Sequence
  Synthetic oligonucleotide
agcaaagtcctgaaggagtgagag

SEQ ID NO: 6997 - DNA, 24 bp, Artificial Sequence
  Synthetic oligonucleotide
agcagcgcaaagcacgtgtgaggc

SEQ ID NO: 6998 - DNA, 23 bp, Artificial Sequence
  Synthetic oligonucleotide
atcaacgtctggactagtgaggg

SEQ ID NO: 6999 - DNA, 23 bp, Artificial Sequence
  Synthetic oligonucleotide
agtagtgtccacagaagtgaggg

SEQ ID NO: 7000 - DNA, 23 bp, Artificial Sequence
  Synthetic oligonucleotide
agcaaagtcccttggagtgagtg

SEQ ID NO: 7001 - DNA, 24 bp, Artificial Sequence
  Synthetic oligonucleotide
agccacgtctatgctttgtgagga

SEQ ID NO: 7002 - DNA, 24 bp, Artificial Sequence
  Synthetic oligonucleotide
agcatggtcgggttctagtgaggg

SEQ ID NO: 7003 - DNA, 24 bp, Artificial Sequence
  Synthetic oligonucleotide
agcagagttgggaaaaagtgaggg

SEQ ID NO: 7004 - DNA, 23 bp, Artificial Sequence
  Synthetic oligonucleotide
agcattgtcactgtgagtgagag

SEQ ID NO: 7005 - DNA, 24 bp, Artificial Sequence
  Synthetic oligonucleotide
agcatggtcaggttctagtgaggg

SEQ ID NO: 7006 - DNA, 24 bp, Artificial Sequence
  Synthetic oligonucleotide
agcatggtcaggttctagtgaggg

SEQ ID NO: 7007 - DNA, 23 bp, Artificial Sequence
  Synthetic oligonucleotide
agcatggtctagcagagtgagtc

SEQ ID NO: 7008 - DNA, 24 bp, Artificial Sequence
  Synthetic oligonucleotide
agctgtgtcatccatgagtgagtc

SEQ ID NO: 7009 - DNA, 24 bp, Artificial Sequence
  Synthetic oligonucleotide
agtagagtctgggtggagtgagac

SEQ ID NO: 7010 - DNA, 24 bp, Artificial Sequence
  Synthetic oligonucleotide
agcatggtcaggttctagtgaggg

SEQ ID NO: 7011 - DNA, 24 bp, Artificial Sequence
  Synthetic oligonucleotide
agctgtgtccaggaggagtgagtc

SEQ ID NO: 7012 - DNA, 23 bp, Artificial Sequence
  Synthetic oligonucleotide
agcaacttctgatctagtgaggt

SEQ ID NO: 7013 - DNA, 23 bp, Artificial Sequence
  Synthetic oligonucleotide
agctgagtcaacctgagtaaggg

SEQ ID NO: 7014 - DNA, 23 bp, Artificial Sequence
  Synthetic oligonucleotide
agtagggtcatcagaagtgaggt

SEQ ID NO: 7015 - DNA, 23 bp, Artificial Sequence
  Synthetic oligonucleotide
agctgtgtcaccttgagtgagtc

SEQ ID NO: 7016 - DNA, 23 bp, Artificial Sequence
  Synthetic oligonucleotide
agcaacatctggaagagtgagag

SEQ ID NO: 7017 - DNA, 23 bp, Artificial Sequence
  Synthetic oligonucleotide
agcatcgtgtttgaaagtgaggc

SEQ ID NO: 7018 - DNA, 24 bp, Artificial Sequence
  Synthetic oligonucleotide
agcatggtcaggttctagtgaggg

SEQ ID NO: 7019 - DNA, 23 bp, Artificial Sequence
  Synthetic oligonucleotide
agcaacttcaggggaagtgaggg

SEQ ID NO: 7020 - DNA, 24 bp, Artificial Sequence
  Synthetic oligonucleotide
agcatggtcagattatagtgaggg

SEQ ID NO: 7021 - DNA, 24 bp, Artificial Sequence
  Synthetic oligonucleotide
agcatggtccgtgtctagtgaggg

SEQ ID NO: 7022 - DNA, 24 bp, Artificial Sequence
  Synthetic oligonucleotide
agcaaggtcacctgagagtgagag

SEQ ID NO: 7023 - DNA, 24 bp, Artificial Sequence
  Synthetic oligonucleotide
agcatggtcaagttctagtgaggg

SEQ ID NO: 7024 - DNA, 23 bp, Artificial Sequence
  Synthetic oligonucleotide
agcagggtataggggagtgagat

SEQ ID NO: 7025 - DNA, 24 bp, Artificial Sequence
  Synthetic oligonucleotide
ggcagagtccaagcagagtgagag

SEQ ID NO: 7026 - DNA, 24 bp, Artificial Sequence
  Synthetic oligonucleotide
agtaacgtcaaaggtgagtgaaaa

SEQ ID NO: 7027 - DNA, 24 bp, Artificial Sequence
  Synthetic oligonucleotide
agcatggtcaatttctagtgaggg

SEQ ID NO: 7028 - DNA, 23 bp, Artificial Sequence
  Synthetic oligonucleotide
agcagtgtggagtggagtgagag

SEQ ID NO: 7029 - DNA, 23 bp, Artificial Sequence
  Synthetic oligonucleotide
agcaccatccccatgagtgagtc

SEQ ID NO: 7030 - DNA, 24 bp, Artificial Sequence
  Synthetic oligonucleotide
agcaacgtgagacagtagtgagaa

SEQ ID NO: 7031 - DNA, 24 bp, Artificial Sequence
  Synthetic oligonucleotide
agcaacggccctgggcagtgaggg

SEQ ID NO: 7032 - DNA, 23 bp, Artificial Sequence
  Synthetic oligonucleotide
agtagagtcatggagagtgagag

SEQ ID NO: 7033 - DNA, 23 bp, Artificial Sequence
  Synthetic oligonucleotide
ggcaccgtcgctgagagtgagtc

SEQ ID NO: 7034 - DNA, 24 bp, Artificial Sequence
  Synthetic oligonucleotide
agcatggtcaggttctagtgaggg

SEQ ID NO: 7035 - DNA, 24 bp, Artificial Sequence
  Synthetic oligonucleotide
agcatagtcaggttctagtgaggg

SEQ ID NO: 7036 - DNA, 23 bp, Artificial Sequence
  Synthetic oligonucleotide
agtaacgtctccctgagtgtggg

SEQ ID NO: 7037 - DNA, 23 bp, Artificial Sequence
  Synthetic oligonucleotide
agcatagtggttaggagtgaggg

SEQ ID NO: 7038 - DNA, 23 bp, Artificial Sequence
  Synthetic oligonucleotide
atcagggtgggtaggagtgaggc

SEQ ID NO: 7039 - DNA, 23 bp, Artificial Sequence
  Synthetic oligonucleotide
tacagagtctccaggagtgaggg

SEQ ID NO: 7040 - DNA, 23 bp, Artificial Sequence
  Synthetic oligonucleotide
atgagggtctcatagagtgaggt

SEQ ID NO: 7041 - DNA, 23 bp, Artificial Sequence
  Synthetic oligonucleotide
agcaaattcttcaggagtgaggt

SEQ ID NO: 7042 - DNA, 24 bp, Artificial Sequence
  Synthetic oligonucleotide
agcaaagtgctcaaagagtgaggc

SEQ ID NO: 7043 - DNA, 24 bp, Artificial Sequence
  Synthetic oligonucleotide
ataagtgtcattgaagagtgaggc

SEQ ID NO: 7044 - DNA, 23 bp, Artificial Sequence
  Synthetic oligonucleotide
agtagtctcttgatgagtgaggg

SEQ ID NO: 7045 - DNA, 24 bp, Artificial Sequence
  Synthetic oligonucleotide
cgcagcaacagcggtgagtgaggg

SEQ ID NO: 7046 - DNA, 23 bp, Artificial Sequence
  Synthetic oligonucleotide
agcaatgtgtgcttgagtgaggc

SEQ ID NO: 7047 - DNA, 24 bp, Artificial Sequence
  Synthetic oligonucleotide
accaaagtctttgatgagtgaggg

SEQ ID NO: 7048 - DNA, 24 bp, Artificial Sequence
  Synthetic oligonucleotide
agtagtgtttcaagagagtgaggc

SEQ ID NO: 7049 - DNA, 24 bp, Artificial Sequence
  Synthetic oligonucleotide
agcatagtggggtaggagtgaggg

SEQ ID NO: 7050 - DNA, 24 bp, Artificial Sequence
  Synthetic oligonucleotide
atcaccatcctaagtgagtgaggg

SEQ ID NO: 7051 - DNA, 23 bp, Artificial Sequence
  Synthetic oligonucleotide
agaatcgtttgaaagagtgaggg

SEQ ID NO: 7052 - DNA, 24 bp, Artificial Sequence
  Synthetic oligonucleotide
agtaacatcggaaaagagtgaggt

SEQ ID NO: 7053 - DNA, 23 bp, Artificial Sequence
  Synthetic oligonucleotide
aggacagtcagttggagtgaggt

SEQ ID NO: 7054 - DNA, 23 bp, Artificial Sequence
  Synthetic oligonucleotide
ggcagtgttgacaggagtgaggc

SEQ ID NO: 7055 - DNA, 23 bp, Artificial Sequence
  Synthetic oligonucleotide
agttgtgtcgttttgagtgaggt

SEQ ID NO: 7056 - DNA, 24 bp, Artificial Sequence
  Synthetic oligonucleotide
cccaccgtcccgcccgagtgaggg

SEQ ID NO: 7057 - DNA, 24 bp, Artificial Sequence
  Synthetic oligonucleotide
agtaccggcttcacagagtgaggt

SEQ ID NO: 7058 - DNA, 24 bp, Artificial Sequence
  Synthetic oligonucleotide
agcaactttggaatggagtgaggg

SEQ ID NO: 7059 - DNA, 23 bp, Artificial Sequence
  Synthetic oligonucleotide
agcaagggcagtgagagtgaggc

SEQ ID NO: 7060 - DNA, 24 bp, Artificial Sequence
  Synthetic oligonucleotide
gtcagggtcataagagagtgaggc

SEQ ID NO: 7061 - DNA, 23 bp, Artificial Sequence
  Synthetic oligonucleotide
aggaaagtctaacagagtgaggt

SEQ ID NO: 7062 - DNA, 23 bp, Artificial Sequence
  Synthetic oligonucleotide
cacagtgtcaggctgagtgaggt

SEQ ID NO: 7063 - DNA, 24 bp, Artificial Sequence
  Synthetic oligonucleotide
gtcagtgtccaagaagagtgaggt

SEQ ID NO: 7064 - DNA, 24 bp, Artificial Sequence
  Synthetic oligonucleotide
atcaccatccagagagagtgaggg

SEQ ID NO: 7065 - DNA, 23 bp, Artificial Sequence
  Synthetic oligonucleotide
atcaacatctttgggagtgaggc

SEQ ID NO: 7066 - DNA, 23 bp, Artificial Sequence
  Synthetic oligonucleotide
ccgagcgtctgaaagagtgaggt

SEQ ID NO: 7067 - DNA, 24 bp, Artificial Sequence
  Synthetic oligonucleotide
agcacagtgagcactgagtgaggg

SEQ ID NO: 7068 - DNA, 23 bp, Artificial Sequence
  Synthetic oligonucleotide
aacattgtctaagggagtgaggt

SEQ ID NO: 7069 - DNA, 23 bp, Artificial Sequence
  Synthetic oligonucleotide
aacattgtctaagggagtgaggt

SEQ ID NO: 7070 - DNA, 23 bp, Artificial Sequence
  Synthetic oligonucleotide
aacattgtctaagggagtgaggt

SEQ ID NO: 7071 - DNA, 24 bp, Artificial Sequence
  Synthetic oligonucleotide
agtaccggcatccatgagtgaggt

SEQ ID NO: 7072 - DNA, 24 bp, Artificial Sequence
  Synthetic oligonucleotide
agtacagtctctgttgagtgagaa

SEQ ID NO: 7073 - DNA, 23 bp, Artificial Sequence
  Synthetic oligonucleotide
aacaacatcacggggagtgaggt

SEQ ID NO: 7074 - DNA, 24 bp, Artificial Sequence
  Synthetic oligonucleotide
tcccgcgtccgggaagagtgaggt

SEQ ID NO: 7075 - DNA, 24 bp, Artificial Sequence
  Synthetic oligonucleotide
aggggagtcagatgcgagtgaggg

SEQ ID NO: 7076 - DNA, 23 bp, Artificial Sequence
  Synthetic oligonucleotide
agtagctgcggccagagtgaggc

SEQ ID NO: 7077 - DNA, 23 bp, Artificial Sequence
  Synthetic oligonucleotide
ggaagggtcagtgcgagtgaggg

SEQ ID NO: 7078 - DNA, 23 bp, Artificial Sequence
  Synthetic oligonucleotide
ggaagggtcagtgcgagtgaggg

SEQ ID NO: 7079 - DNA, 23 bp, Artificial Sequence
  Synthetic oligonucleotide
ggaagggtcagtgcgagtgaggg

SEQ ID NO: 7080 - DNA, 23 bp, Artificial Sequence
  Synthetic oligonucleotide
ggaagggtcagtgcgagtgaggg

SEQ ID NO: 7081 - DNA, 23 bp, Artificial Sequence
  Synthetic oligonucleotide
ggaagggtcagtgcgagtgaggg

SEQ ID NO: 7082 - DNA, 23 bp, Artificial Sequence
  Synthetic oligonucleotide
ggaagggtcagtgcgagtgaggg

SEQ ID NO: 7083 - DNA, 23 bp, Artificial Sequence
  Synthetic oligonucleotide
ctcagtgtctcccagagtgaggc

SEQ ID NO: 7084 - DNA, 23 bp, Artificial Sequence
  Synthetic oligonucleotide
agtaaagtcacaaggagtgaggt

SEQ ID NO: 7085 - DNA, 23 bp, Artificial Sequence
  Synthetic oligonucleotide
aacggggtctgggagagtgaggt

SEQ ID NO: 7086 - DNA, 23 bp, Artificial Sequence
  Synthetic oligonucleotide
gggagggtccccatgagtgaggg

SEQ ID NO: 7087 - DNA, 24 bp, Artificial Sequence
  Synthetic oligonucleotide
ggcagggttaagattgagtgaggc

SEQ ID NO: 7088 - DNA, 24 bp, Artificial Sequence
  Synthetic oligonucleotide
aggggagtctgaggggagtgaggg

SEQ ID NO: 7089 - DNA, 23 bp, Artificial Sequence
  Synthetic oligonucleotide
aacaatgtcatgttgagtgaggg

SEQ ID NO: 7090 - DNA, 23 bp, Artificial Sequence
  Synthetic oligonucleotide
agcttggtctggctgagtgaggt

SEQ ID NO: 7091 - DNA, 23 bp, Artificial Sequence
  Synthetic oligonucleotide
atgagggtctcatagagtgaggt

SEQ ID NO: 7092 - DNA, 24 bp, Artificial Sequence
  Synthetic oligonucleotide
gccagtgtctcttaggagtgaggt

SEQ ID NO: 7093 - DNA, 23 bp, Artificial Sequence
  Synthetic oligonucleotide
atcacagtctctgggagtgaggc

SEQ ID NO: 7094 - DNA, 23 bp, Artificial Sequence
  Synthetic oligonucleotide
gacagggtcttaatgagtgaggc

SEQ ID NO: 7095 - DNA, 24 bp, Artificial Sequence
  Synthetic oligonucleotide
agccttgtcgtaactgagtgaggt

SEQ ID NO: 7096 - DNA, 23 bp, Artificial Sequence
  Synthetic oligonucleotide
ggcagcggtgttcagagtgaggg

SEQ ID NO: 7097 - DNA, 23 bp, Artificial Sequence
  Synthetic oligonucleotide
tccagtgtctatgggagtgaggc

SEQ ID NO: 7098 - DNA, 23 bp, Artificial Sequence
  Synthetic oligonucleotide
agcagctgtgatgtgagtgaggg

SEQ ID NO: 7099 - DNA, 23 bp, Artificial Sequence
  Synthetic oligonucleotide
agcagctcacatgggagtgaggt

SEQ ID NO: 7100 - DNA, 23 bp, Artificial Sequence
  Synthetic oligonucleotide
ggcaacggcacacagagggagga

SEQ ID NO: 7101 - DNA, 23 bp, Artificial Sequence
  Synthetic oligonucleotide
agctgagttaagcagagtgaggt

SEQ ID NO: 7102 - DNA, 24 bp, Artificial Sequence
  Synthetic oligonucleotide
agcagcacaaagctggagtgaggg

SEQ ID NO: 7103 - DNA, 23 bp, Artificial Sequence
  Synthetic oligonucleotide
agcaaccttgagatgagtgaggc

SEQ ID NO: 7104 - DNA, 24 bp, Artificial Sequence
  Synthetic oligonucleotide
agcaaattcgggcccgagtgaggt

SEQ ID NO: 7105 - DNA, 23 bp, Artificial Sequence
  Synthetic oligonucleotide
agacgggtcggcccgagtgaggt

SEQ ID NO: 7106 - DNA, 24 bp, Artificial Sequence
  Synthetic oligonucleotide
gccagagtctgcacagagtgaggg

SEQ ID NO: 7107 - DNA, 24 bp, Artificial Sequence
  Synthetic oligonucleotide
agcaacagcatttgggagtgaggg

SEQ ID NO: 7108 - DNA, 24 bp, Artificial Sequence
  Synthetic oligonucleotide
aaccgagtcactcaagagtgaggg

SEQ ID NO: 7109 - DNA, 24 bp, Artificial Sequence
  Synthetic oligonucleotide
agcagctcaccagcagagtgaggt

SEQ ID NO: 7110 - DNA, 24 bp, Artificial Sequence
  Synthetic oligonucleotide
ggaagggtcctgtgtgagtgaggg

SEQ ID NO: 7111 - DNA, 23 bp, Artificial Sequence
  Synthetic oligonucleotide
agaacggtccagcagagtgaggc

SEQ ID NO: 7112 - DNA, 23 bp, Artificial Sequence
  Synthetic oligonucleotide
agcaaggtaaggaaaagtgagga

SEQ ID NO: 7113 - DNA, 24 bp, Artificial Sequence
  Synthetic oligonucleotide
agaatggtcagtggggagtgaggg

SEQ ID NO: 7114 - DNA, 23 bp, Artificial Sequence
  Synthetic oligonucleotide
agaatggtccaaatgagtgaggg

SEQ ID NO: 7115 - DNA, 23 bp, Artificial Sequence
  Synthetic oligonucleotide
agcaagggctccgtgagtgaggg

SEQ ID NO: 7116 - DNA, 24 bp, Artificial Sequence
  Synthetic oligonucleotide
tgctgagtctccatggagtgaggg

SEQ ID NO: 7117 - DNA, 24 bp, Artificial Sequence
  Synthetic oligonucleotide
agcattgtttctggggagtgaggg

SEQ ID NO: 7118 - DNA, 23 bp, Artificial Sequence
  Synthetic oligonucleotide
agcattgtggtgaggagtgaggg

SEQ ID NO: 7119 - DNA, 23 bp, Artificial Sequence
  Synthetic oligonucleotide
gctagcgtccatgggagtgaggc

SEQ ID NO: 7120 - DNA, 24 bp, Artificial Sequence
  Synthetic oligonucleotide
agcaactttccactggagtgaggc

SEQ ID NO: 7121 - DNA, 23 bp, Artificial Sequence
  Synthetic oligonucleotide
agtagggttggtgggagtgaggg

SEQ ID NO: 7122 - DNA, 24 bp, Artificial Sequence
  Synthetic oligonucleotide
ggcagtgtttcccaggagtgaggc

SEQ ID NO: 7123 - DNA, 23 bp, Artificial Sequence
  Synthetic oligonucleotide
aactgagtctctgggagtgaggt

SEQ ID NO: 7124 - DNA, 23 bp, Artificial Sequence
  Synthetic oligonucleotide
agcattgtgatgaggagtgaggg

SEQ ID NO: 7125 - DNA, 23 bp, Artificial Sequence
  Synthetic oligonucleotide
agcaaggtttatgtgagtgagca

SEQ ID NO: 7126 - DNA, 23 bp, Artificial Sequence
  Synthetic oligonucleotide
ggcaacgtttgtatgagtgaggt

SEQ ID NO: 7127 - DNA, 24 bp, Artificial Sequence
  Synthetic oligonucleotide
aacaacctcgcctatgagtgaggg

SEQ ID NO: 7128 - DNA, 23 bp, Artificial Sequence
  Synthetic oligonucleotide
agggacgtccaagggagtgaggg

SEQ ID NO: 7129 - DNA, 24 bp, Artificial Sequence
  Synthetic oligonucleotide
tccagtgtcacatcagagtgaggc

SEQ ID NO: 7130 - DNA, 24 bp, Artificial Sequence
  Synthetic oligonucleotide
agcatggttggagtagagtgaggg

SEQ ID NO: 7131 - DNA, 23 bp, Artificial Sequence
  Synthetic oligonucleotide
aatagggtcaaaatgagtgaggt

SEQ ID NO: 7132 - DNA, 24 bp, Artificial Sequence
  Synthetic oligonucleotide
agtatagtctttagggagtgaggc

SEQ ID NO: 7133 - DNA, 23 bp, Artificial Sequence
  Synthetic oligonucleotide
tgcaatgtccttgggagtgaggc

SEQ ID NO: 7134 - DNA, 24 bp, Artificial Sequence
  Synthetic oligonucleotide
agctacatctacagggagtgaggg

SEQ ID NO: 7135 - DNA, 24 bp, Artificial Sequence
  Synthetic oligonucleotide
agcaaagtaaagagagagtgaggc

SEQ ID NO: 7136 - DNA, 24 bp, Artificial Sequence
  Synthetic oligonucleotide
caccccgtctacctggagtgagga

SEQ ID NO: 7137 - DNA, 23 bp, Artificial Sequence
  Synthetic oligonucleotide
aggcacgttaggcagagtgagga

SEQ ID NO: 7138 - DNA, 24 bp, Artificial Sequence
  Synthetic oligonucleotide
caccccgtcgacgtcgagtgagga

SEQ ID NO: 7139 - DNA, 23 bp, Artificial Sequence
  Synthetic oligonucleotide
gcaagagtctggctgagtgagga

SEQ ID NO: 7140 - DNA, 23 bp, Artificial Sequence
  Synthetic oligonucleotide
agtgcagtcccttagagtgagga

SEQ ID NO: 7141 - DNA, 24 bp, Artificial Sequence
  Synthetic oligonucleotide
atccacgttatgctggagtgagga

SEQ ID NO: 7142 - DNA, 23 bp, Artificial Sequence
  Synthetic oligonucleotide
atccacgttttggggagtgagga

SEQ ID NO: 7143 - DNA, 24 bp, Artificial Sequence
  Synthetic oligonucleotide
agcagcttctgccatgagtgaagt

SEQ ID NO: 7144 - DNA, 24 bp, Artificial Sequence
  Synthetic oligonucleotide
agcagggtctgcagtgagagaggc

SEQ ID NO: 7145 - DNA, 23 bp, Artificial Sequence
  Synthetic oligonucleotide
agcagcttccaggagagtgaagt

SEQ ID NO: 7146 - DNA, 24 bp, Artificial Sequence
  Synthetic oligonucleotide
agcagggtctgttttgagtgagtt

SEQ ID NO: 7147 - DNA, 23 bp, Artificial Sequence
  Synthetic oligonucleotide
agcaactgcattttgagtgaggg

SEQ ID NO: 7148 - DNA, 23 bp, Artificial Sequence
  Synthetic oligonucleotide
agcaactgcatcttgagtgaggg

SEQ ID NO: 7149 - DNA, 24 bp, Artificial Sequence
  Synthetic oligonucleotide
agcagcttcccaaaaatgtgagga

SEQ ID NO: 7150 - DNA, 24 bp, Artificial Sequence
  Synthetic oligonucleotide
aggtgcctccccatggagtgagga

SEQ ID NO: 7151 - DNA, 23 bp, Artificial Sequence
  Synthetic oligonucleotide
agctcagtccacaggagtgagtc

SEQ ID NO: 7152 - DNA, 23 bp, Artificial Sequence
  Synthetic oligonucleotide
agcagcgtgcagaagagagagga

SEQ ID NO: 7153 - DNA, 24 bp, Artificial Sequence
  Synthetic oligonucleotide
agcagcgtggatggagagagagga

SEQ ID NO: 7154 - DNA, 24 bp, Artificial Sequence
  Synthetic oligonucleotide
agcagcgtggatggagagagagga

SEQ ID NO: 7155 - DNA, 24 bp, Artificial Sequence
  Synthetic oligonucleotide
agcagcgtggatggagagagagga

SEQ ID NO: 7156 - DNA, 24 bp, Artificial Sequence
  Synthetic oligonucleotide
agcagcctctgccaggggtgagga

SEQ ID NO: 7157 - DNA, 23 bp, Artificial Sequence
  Synthetic oligonucleotide
agcagcctcccatagagggagga

SEQ ID NO: 7158 - DNA, 24 bp, Artificial Sequence
  Synthetic oligonucleotide
aggagcgtcccttgggagtgatga

SEQ ID NO: 7159 - DNA, 23 bp, Artificial Sequence
  Synthetic oligonucleotide
agcagcgacagccagagtgacga

SEQ ID NO: 7160 - DNA, 23 bp, Artificial Sequence
  Synthetic oligonucleotide
agctgcgtcctgtagcgtgagga

SEQ ID NO: 7161 - DNA, 23 bp, Artificial Sequence
  Synthetic oligonucleotide
agcagggtctgcctgagtcagga

SEQ ID NO: 7162 - DNA, 23 bp, Artificial Sequence
  Synthetic oligonucleotide
agcagcatctgggagaatgagga

SEQ ID NO: 7163 - DNA, 24 bp, Artificial Sequence
  Synthetic oligonucleotide
aggagcgtccagtgcgactgagga

SEQ ID NO: 7164 - DNA, 24 bp, Artificial Sequence
  Synthetic oligonucleotide
agcagcgtggatggagagagagga

SEQ ID NO: 7165 - DNA, 24 bp, Artificial Sequence
  Synthetic oligonucleotide
agcagcgtggatggagagagagga

SEQ ID NO: 7166 - DNA, 24 bp, Artificial Sequence
  Synthetic oligonucleotide
agcagcatcacagacgcgtgagga

SEQ ID NO: 7167 - DNA, 24 bp, Artificial Sequence
  Synthetic oligonucleotide
accagcgtctgctttgggtgagga

SEQ ID NO: 7168 - DNA, 23 bp, Artificial Sequence
  Synthetic oligonucleotide
agcagggtcattgagaatgagga

SEQ ID NO: 7169 - DNA, 23 bp, Artificial Sequence
  Synthetic oligonucleotide
aggagcgacggggggagtgagga

SEQ ID NO: 7170 - DNA, 23 bp, Artificial Sequence
  Synthetic oligonucleotide
aggagcgacggggggagtgagga

SEQ ID NO: 7171 - DNA, 23 bp, Artificial Sequence
  Synthetic oligonucleotide
aggagcgacggggggagtgagga

SEQ ID NO: 7172 - DNA, 23 bp, Artificial Sequence
  Synthetic oligonucleotide
aggagcgacggggggagtgagga

SEQ ID NO: 7173 - DNA, 23 bp, Artificial Sequence
  Synthetic oligonucleotide
aggagcgacggggggagtgagga

SEQ ID NO: 7174 - DNA, 23 bp, Artificial Sequence
  Synthetic oligonucleotide
aggagcgacggggggagtgagga

SEQ ID NO: 7175 - DNA, 23 bp, Artificial Sequence
  Synthetic oligonucleotide
aggagcgacggggggagtgagga

SEQ ID NO: 7176 - DNA, 23 bp, Artificial Sequence
  Synthetic oligonucleotide
aggagcgacggggggagtgagga

SEQ ID NO: 7177 - DNA, 23 bp, Artificial Sequence
  Synthetic oligonucleotide
aggagcgacggggggagtgagga

SEQ ID NO: 7178 - DNA, 23 bp, Artificial Sequence
  Synthetic oligonucleotide
aggagcgacggggggagtgagga

SEQ ID NO: 7179 - DNA, 23 bp, Artificial Sequence
  Synthetic oligonucleotide
aggagcgacggggggagtgagga

SEQ ID NO: 7180 - DNA, 23 bp, Artificial Sequence
  Synthetic oligonucleotide
aggagcgacggggggagtgagga

SEQ ID NO: 7181 - DNA, 23 bp, Artificial Sequence
  Synthetic oligonucleotide
aggagcgacggggggagtgagga

SEQ ID NO: 7182 - DNA, 23 bp, Artificial Sequence
  Synthetic oligonucleotide
aggagcgacggggggagtgagga

SEQ ID NO: 7183 - DNA, 23 bp, Artificial Sequence
  Synthetic oligonucleotide
aggagcgacggggggagtgagga

SEQ ID NO: 7184 - DNA, 23 bp, Artificial Sequence
  Synthetic oligonucleotide
aggagcgacggggggagtgagga

SEQ ID NO: 7185 - DNA, 23 bp, Artificial Sequence
  Synthetic oligonucleotide
aggagcgacggggggagtgagga

SEQ ID NO: 7186 - DNA, 23 bp, Artificial Sequence
  Synthetic oligonucleotide
aggagcgacggggggagtgagga

SEQ ID NO: 7187 - DNA, 23 bp, Artificial Sequence
  Synthetic oligonucleotide
aggagcgacggggggagtgagga

SEQ ID NO: 7188 - DNA, 23 bp, Artificial Sequence
  Synthetic oligonucleotide
aggagcgacggggggagtgagga

SEQ ID NO: 7189 - DNA, 23 bp, Artificial Sequence
  Synthetic oligonucleotide
aggagcgacggggggagtgagga

SEQ ID NO: 7190 - DNA, 23 bp, Artificial Sequence
  Synthetic oligonucleotide
aggagcgacggggggagtgagga

SEQ ID NO: 7191 - DNA, 23 bp, Artificial Sequence
  Synthetic oligonucleotide
aggagcgacggggggagtgagga

SEQ ID NO: 7192 - DNA, 23 bp, Artificial Sequence
  Synthetic oligonucleotide
aggagcgacggggggagtgagga

SEQ ID NO: 7193 - DNA, 23 bp, Artificial Sequence
  Synthetic oligonucleotide
aggagcgacggggggagtgagga

SEQ ID NO: 7194 - DNA, 23 bp, Artificial Sequence
  Synthetic oligonucleotide
aggagcgacggggggagtgagga

SEQ ID NO: 7195 - DNA, 23 bp, Artificial Sequence
  Synthetic oligonucleotide
aggagcgacggggggagtgagga

SEQ ID NO: 7196 - DNA, 23 bp, Artificial Sequence
  Synthetic oligonucleotide
aggagcgacggggggagtgagga

SEQ ID NO: 7197 - DNA, 23 bp, Artificial Sequence
  Synthetic oligonucleotide
aggagcgacggggggagtgagga

SEQ ID NO: 7198 - DNA, 23 bp, Artificial Sequence
  Synthetic oligonucleotide
aggagcgacggggggagtgagga

SEQ ID NO: 7199 - DNA, 23 bp, Artificial Sequence
  Synthetic oligonucleotide
aggagcgacggggggagtgagga

SEQ ID NO: 7200 - DNA, 23 bp, Artificial Sequence
  Synthetic oligonucleotide
aggagcgacggggggagtgagga

SEQ ID NO: 7201 - DNA, 23 bp, Artificial Sequence
  Synthetic oligonucleotide
aggagcgacggggggagtgagga

SEQ ID NO: 7202 - DNA, 23 bp, Artificial Sequence
  Synthetic oligonucleotide
aggagcgacggggggagtgagga

SEQ ID NO: 7203 - DNA, 23 bp, Artificial Sequence
  Synthetic oligonucleotide
aacagcctccttccgagtgagga

SEQ ID NO: 7204 - DNA, 24 bp, Artificial Sequence
  Synthetic oligonucleotide
agaagcatccgaagggagtgagga

SEQ ID NO: 7205 - DNA, 24 bp, Artificial Sequence
  Synthetic oligonucleotide
agaagcctccattccgagtgagga

SEQ ID NO: 7206 - DNA, 23 bp, Artificial Sequence
  Synthetic oligonucleotide
agcagcgtcaggggaaattagga

SEQ ID NO: 7207 - DNA, 24 bp, Artificial Sequence
  Synthetic oligonucleotide
agcagcgtcttggaagaccgaggt

SEQ ID NO: 7208 - DNA, 23 bp, Artificial Sequence
  Synthetic oligonucleotide
agcagcgtcctgtggcgtggcga

SEQ ID NO: 7209 - DNA, 24 bp, Artificial Sequence
  Synthetic oligonucleotide
agcagcgtctcagcgggtggagga

SEQ ID NO: 7210 - DNA, 24 bp, Artificial Sequence
  Synthetic oligonucleotide
agcagcgtccgccgagagtcagcc

SEQ ID NO: 7211 - DNA, 24 bp, Artificial Sequence
  Synthetic oligonucleotide
agcagcgtcagggagaagtcaggt

SEQ ID NO: 7212 - DNA, 24 bp, Artificial Sequence
  Synthetic oligonucleotide
agcagcgtcaacagtgcctgatga

SEQ ID NO: 7213 - DNA, 24 bp, Artificial Sequence
  Synthetic oligonucleotide
agcagcgtcagtagagacagagaa

SEQ ID NO: 7214 - DNA, 24 bp, Artificial Sequence
  Synthetic oligonucleotide
agcagcgtcgggtgggtttgggga

SEQ ID NO: 7215 - DNA, 24 bp, Artificial Sequence
  Synthetic oligonucleotide
agcagcgtctccgaagagacagca

SEQ ID NO: 7216 - DNA, 23 bp, Artificial Sequence
  Synthetic oligonucleotide
agcagcgtcccgaggagctggga

SEQ ID NO: 7217 - DNA, 23 bp, Artificial Sequence
  Synthetic oligonucleotide
agcagcgtccggccgcggcagga

SEQ ID NO: 7218 - DNA, 23 bp, Artificial Sequence
  Synthetic oligonucleotide
agcagcgtccggccgcggcagga

SEQ ID NO: 7219 - DNA, 24 bp, Artificial Sequence
  Synthetic oligonucleotide
agcagcgtcactcccaagcgagta

SEQ ID NO: 7220 - DNA, 23 bp, Artificial Sequence
  Synthetic oligonucleotide
agcagcgtcccctgcagagagca

SEQ ID NO: 7221 - DNA, 24 bp, Artificial Sequence
  Synthetic oligonucleotide
agcagcgtctctctgggctgggga

SEQ ID NO: 7222 - DNA, 24 bp, Artificial Sequence
  Synthetic oligonucleotide
agcagcgtccaggagggctgggga

SEQ ID NO: 7223 - DNA, 24 bp, Artificial Sequence
  Synthetic oligonucleotide
agcagcgtcagggtggagtcatgt

SEQ ID NO: 7224 - DNA, 24 bp, Artificial Sequence
  Synthetic oligonucleotide
agcagcgtctgattggcgggggga

SEQ ID NO: 7225 - DNA, 23 bp, Artificial Sequence
  Synthetic oligonucleotide
agcagcgtctggggaattgggga

SEQ ID NO: 7226 - DNA, 24 bp, Artificial Sequence
  Synthetic oligonucleotide
agcagcgtccgccgagagtcagcc

SEQ ID NO: 7227 - DNA, 23 bp, Artificial Sequence
  Synthetic oligonucleotide
agcagtgtcagttggcgggagga

SEQ ID NO: 7228 - DNA, 24 bp, Artificial Sequence
  Synthetic oligonucleotide
agcagagtccaaaaggggtgaggc

SEQ ID NO: 7229 - DNA, 23 bp, Artificial Sequence
  Synthetic oligonucleotide
atcagcgtccagaggagtgaaca

SEQ ID NO: 7230 - DNA, 24 bp, Artificial Sequence
  Synthetic oligonucleotide
agcagagtctcagaggagtgaagc

SEQ ID NO: 7231 - DNA, 24 bp, Artificial Sequence
  Synthetic oligonucleotide
aacagcgtcctgggagagtgtgca

SEQ ID NO: 7232 - DNA, 23 bp, Artificial Sequence
  Synthetic oligonucleotide
tgcagcgtcttctttagtgagca

SEQ ID NO: 7233 - DNA, 24 bp, Artificial Sequence
  Synthetic oligonucleotide
agcagcttccaacaatagtaagga

SEQ ID NO: 7234 - DNA, 24 bp, Artificial Sequence
  Synthetic oligonucleotide
agcagtgtcccctataagtgagaa

SEQ ID NO: 7235 - DNA, 23 bp, Artificial Sequence
  Synthetic oligonucleotide
agcagcatcaatctgagtgtggg

SEQ ID NO: 7236 - DNA, 23 bp, Artificial Sequence
  Synthetic oligonucleotide
agcagtgtcaacatcagtgagaa

SEQ ID NO: 7237 - DNA, 23 bp, Artificial Sequence
  Synthetic oligonucleotide
agcagcttctcccagggtgaggc

SEQ ID NO: 7238 - DNA, 23 bp, Artificial Sequence
  Synthetic oligonucleotide
agcagagtcaggcagggtgaggc

SEQ ID NO: 7239 - DNA, 24 bp, Artificial Sequence
  Synthetic oligonucleotide
agcagggtctgcagggagtgtggt

SEQ ID NO: 7240 - DNA, 23 bp, Artificial Sequence
  Synthetic oligonucleotide
agctgcgtcctctagagggaggg

SEQ ID NO: 7241 - DNA, 23 bp, Artificial Sequence
  Synthetic oligonucleotide
agcagcgtacctgggtgtgagaa

SEQ ID NO: 7242 - DNA, 24 bp, Artificial Sequence
  Synthetic oligonucleotide
agcagcctcagaaataggtgagga

SEQ ID NO: 7243 - DNA, 23 bp, Artificial Sequence
  Synthetic oligonucleotide
agcagcgttcctctcagtgatga

SEQ ID NO: 7244 - DNA, 24 bp, Artificial Sequence
  Synthetic oligonucleotide
agcagcctctggagggagggaggg

SEQ ID NO: 7245 - DNA, 24 bp, Artificial Sequence
  Synthetic oligonucleotide
agcagtgtcagatggtggtgagga

SEQ ID NO: 7246 - DNA, 24 bp, Artificial Sequence
  Synthetic oligonucleotide
agcagtgtcttgttaaagtgaaga

SEQ ID NO: 7247 - DNA, 24 bp, Artificial Sequence
  Synthetic oligonucleotide
agcagcatctgggtagagtgaagg

SEQ ID NO: 7248 - DNA, 23 bp, Artificial Sequence
  Synthetic oligonucleotide
agcagcatcctcctgggtaagga

SEQ ID NO: 7249 - DNA, 23 bp, Artificial Sequence
  Synthetic oligonucleotide
agcagggtccctctgagtggggc

SEQ ID NO: 7250 - DNA, 24 bp, Artificial Sequence
  Synthetic oligonucleotide
atcagcgtctttcttgagtgataa

SEQ ID NO: 7251 - DNA, 23 bp, Artificial Sequence
  Synthetic oligonucleotide
agcagcatcctcctgggtaagga

SEQ ID NO: 7252 - DNA, 23 bp, Artificial Sequence
  Synthetic oligonucleotide
agcagcatcctcctgggtaagga

SEQ ID NO: 7253 - DNA, 23 bp, Artificial Sequence
  Synthetic oligonucleotide
agcagcatcctcctgggtaagga

SEQ ID NO: 7254 - DNA, 23 bp, Artificial Sequence
  Synthetic oligonucleotide
agcagcatcctcctgggtaagga

SEQ ID NO: 7255 - DNA, 24 bp, Artificial Sequence
  Synthetic oligonucleotide
agcagtgtcttaggggaatgaggc

SEQ ID NO: 7256 - DNA, 24 bp, Artificial Sequence
  Synthetic oligonucleotide
agcagcttccaggcagagggagaa

SEQ ID NO: 7257 - DNA, 24 bp, Artificial Sequence
  Synthetic oligonucleotide
agcagcgtgctgcgagagtgtgaa

SEQ ID NO: 7258 - DNA, 23 bp, Artificial Sequence
  Synthetic oligonucleotide
agtagcgtccttgggattgaaga

SEQ ID NO: 7259 - DNA, 24 bp, Artificial Sequence
  Synthetic oligonucleotide
agcagcttccagactgagggagaa

SEQ ID NO: 7260 - DNA, 23 bp, Artificial Sequence
  Synthetic oligonucleotide
agcagcgtggaggagagagaggc

SEQ ID NO: 7261 - DNA, 23 bp, Artificial Sequence
  Synthetic oligonucleotide
atcagcgtcatccagaaggagga

SEQ ID NO: 7262 - DNA, 24 bp, Artificial Sequence
  Synthetic oligonucleotide
agcagcatcaaagaggagagaggg

SEQ ID NO: 7263 - DNA, 24 bp, Artificial Sequence
  Synthetic oligonucleotide
agcagtgtcttccatgagtgggta

SEQ ID NO: 7264 - DNA, 23 bp, Artificial Sequence
  Synthetic oligonucleotide
agcagcgactgtagaaatgagga

SEQ ID NO: 7265 - DNA, 24 bp, Artificial Sequence
  Synthetic oligonucleotide
agcagtgtcgatacatggtgagga

SEQ ID NO: 7266 - DNA, 23 bp, Artificial Sequence
  Synthetic oligonucleotide
agcagcgtggagaggaggaagga

SEQ ID NO: 7267 - DNA, 23 bp, Artificial Sequence
  Synthetic oligonucleotide
agcagcttcactgtgactgaaga

SEQ ID NO: 7268 - DNA, 23 bp, Artificial Sequence
  Synthetic oligonucleotide
agcagagtcctcttttgtgagga

SEQ ID NO: 7269 - DNA, 23 bp, Artificial Sequence
  Synthetic oligonucleotide
agcagcttctccagcagtgatga

SEQ ID NO: 7270 - DNA, 23 bp, Artificial Sequence
  Synthetic oligonucleotide
agcagtgtcatactaagggagga

SEQ ID NO: 7271 - DNA, 23 bp, Artificial Sequence
  Synthetic oligonucleotide
agccgcgtctccaagagtcagta

SEQ ID NO: 7272 - DNA, 24 bp, Artificial Sequence
  Synthetic oligonucleotide
tgcagcgtcaaattggagtaaggg

SEQ ID NO: 7273 - DNA, 24 bp, Artificial Sequence
  Synthetic oligonucleotide
agcagcatcagaggtgtgtgagaa

SEQ ID NO: 7274 - DNA, 24 bp, Artificial Sequence
  Synthetic oligonucleotide
agcagcgtgttcatggagtgcggc

SEQ ID NO: 7275 - DNA, 23 bp, Artificial Sequence
  Synthetic oligonucleotide
agcagtgtcctttgcagtgagaa

SEQ ID NO: 7276 - DNA, 23 bp, Artificial Sequence
  Synthetic oligonucleotide
agcagcgcctctcagagtgaaca

SEQ ID NO: 7277 - DNA, 23 bp, Artificial Sequence
  Synthetic oligonucleotide
agcagcatcttgggaactgagga

SEQ ID NO: 7278 - DNA, 24 bp, Artificial Sequence
  Synthetic oligonucleotide
agcagcctctttttggagggaggg

SEQ ID NO: 7279 - DNA, 23 bp, Artificial Sequence
  Synthetic oligonucleotide
ggcagcgtcgcagggagtgggaa

SEQ ID NO: 7280 - DNA, 24 bp, Artificial Sequence
  Synthetic oligonucleotide
agcagcctcggaaacaagtgaggg

SEQ ID NO: 7281 - DNA, 24 bp, Artificial Sequence
  Synthetic oligonucleotide
agcagagtctgatatgagtgagct

SEQ ID NO: 7282 - DNA, 23 bp, Artificial Sequence
  Synthetic oligonucleotide
tgcagcgtcagcatgagtggggc

SEQ ID NO: 7283 - DNA, 24 bp, Artificial Sequence
  Synthetic oligonucleotide
agcagggtctggagggagacagga

SEQ ID NO: 7284 - DNA, 24 bp, Artificial Sequence
  Synthetic oligonucleotide
agcagagtcacgagagaatgggga

SEQ ID NO: 7285 - DNA, 23 bp, Artificial Sequence
  Synthetic oligonucleotide
agcagggtcctgcagggtgaggc

SEQ ID NO: 7286 - DNA, 24 bp, Artificial Sequence
  Synthetic oligonucleotide
agcagcctcagggatgagggaggt

SEQ ID NO: 7287 - DNA, 23 bp, Artificial Sequence
  Synthetic oligonucleotide
agcagcggcatcgggggcgagga

SEQ ID NO: 7288 - DNA, 24 bp, Artificial Sequence
  Synthetic oligonucleotide
agcagggtcatcacagagggaaga

SEQ ID NO: 7289 - DNA, 24 bp, Artificial Sequence
  Synthetic oligonucleotide
agcagtgtctggtgtgagggagca

SEQ ID NO: 7290 - DNA, 24 bp, Artificial Sequence
  Synthetic oligonucleotide
agcagcggctggggggaggcagga

SEQ ID NO: 7291 - DNA, 24 bp, Artificial Sequence
  Synthetic oligonucleotide
agcagcatccctggagagggagaa

SEQ ID NO: 7292 - DNA, 24 bp, Artificial Sequence
  Synthetic oligonucleotide
agcagggtcggtgtctggtgagga

SEQ ID NO: 7293 - DNA, 23 bp, Artificial Sequence
  Synthetic oligonucleotide
agcagggtccaggtaagagagga

SEQ ID NO: 7294 - DNA, 24 bp, Artificial Sequence
  Synthetic oligonucleotide
agcagtgtcatctctgagtggaga

SEQ ID NO: 7295 - DNA, 24 bp, Artificial Sequence
  Synthetic oligonucleotide
agcagcctccgtctagagggaggt

SEQ ID NO: 7296 - DNA, 24 bp, Artificial Sequence
  Synthetic oligonucleotide
agcagcgccagcctcaagtgaggg

SEQ ID NO: 7297 - DNA, 23 bp, Artificial Sequence
  Synthetic oligonucleotide
agcagcgacattgtgagtaagca

SEQ ID NO: 7298 - DNA, 23 bp, Artificial Sequence
  Synthetic oligonucleotide
agcagcttccggtgtagtgatga

SEQ ID NO: 7299 - DNA, 24 bp, Artificial Sequence
  Synthetic oligonucleotide
agcagggtcccagcagagaaagga

SEQ ID NO: 7300 - DNA, 23 bp, Artificial Sequence
  Synthetic oligonucleotide
agcagcgactccgggagtgcaga

SEQ ID NO: 7301 - DNA, 23 bp, Artificial Sequence
  Synthetic oligonucleotide
agcagcgtgggaaagaggaagga

SEQ ID NO: 7302 - DNA, 24 bp, Artificial Sequence
  Synthetic oligonucleotide
ggcagcgtctatggagaatgagaa

SEQ ID NO: 7303 - DNA, 24 bp, Artificial Sequence
  Synthetic oligonucleotide
agcagcctccacactgagggaggt

SEQ ID NO: 7304 - DNA, 24 bp, Artificial Sequence
  Synthetic oligonucleotide
agcagcctccctcttgtgtgaggg

SEQ ID NO: 7305 - DNA, 23 bp, Artificial Sequence
  Synthetic oligonucleotide
tgcagcgtcgctgaaagtgagaa

SEQ ID NO: 7306 - DNA, 24 bp, Artificial Sequence
  Synthetic oligonucleotide
agcagtgtcttgtatgactgaggt

SEQ ID NO: 7307 - DNA, 24 bp, Artificial Sequence
  Synthetic oligonucleotide
agcaacgtcagcaaagtgtcagga

SEQ ID NO: 7308 - DNA, 23 bp, Artificial Sequence
  Synthetic oligonucleotide
agcagcatcagcaggagtgtgaa

SEQ ID NO: 7309 - DNA, 23 bp, Artificial Sequence
  Synthetic oligonucleotide
agcagcctcattgggagtgagtg

SEQ ID NO: 7310 - DNA, 24 bp, Artificial Sequence
  Synthetic oligonucleotide
agcagggtcttggatgagttaaga

SEQ ID NO: 7311 - DNA, 23 bp, Artificial Sequence
  Synthetic oligonucleotide
agcagcggcagactgagcgagca

SEQ ID NO: 7312 - DNA, 24 bp, Artificial Sequence
  Synthetic oligonucleotide
agcagggtcctgttggagacagga

SEQ ID NO: 7313 - DNA, 23 bp, Artificial Sequence
  Synthetic oligonucleotide
agcagcatcagcatcagttagga

SEQ ID NO: 7314 - DNA, 24 bp, Artificial Sequence
  Synthetic oligonucleotide
agcagagtcagaaatgagtgaagc

SEQ ID NO: 7315 - DNA, 24 bp, Artificial Sequence
  Synthetic oligonucleotide
agcagcgcccacccttggtgagga

SEQ ID NO: 7316 - DNA, 23 bp, Artificial Sequence
  Synthetic oligonucleotide
agcagcggctgatggaggcagga

SEQ ID NO: 7317 - DNA, 24 bp, Artificial Sequence
  Synthetic oligonucleotide
agcagcctcgctttgaggtgagga

SEQ ID NO: 7318 - DNA, 24 bp, Artificial Sequence
  Synthetic oligonucleotide
agcatcgtcatcctagagtcagca

SEQ ID NO: 7319 - DNA, 23 bp, Artificial Sequence
  Synthetic oligonucleotide
ggcagcgtcgggcagagggagaa

SEQ ID NO: 7320 - DNA, 23 bp, Artificial Sequence
  Synthetic oligonucleotide
agcagcctcatcctgtgagagga

SEQ ID NO: 7321 - DNA, 24 bp, Artificial Sequence
  Synthetic oligonucleotide
agcagtgtcttccatgagtgggta

SEQ ID NO: 7322 - DNA, 24 bp, Artificial Sequence
  Synthetic oligonucleotide
ggcagcgtccaatctcagtgagaa

SEQ ID NO: 7323 - DNA, 24 bp, Artificial Sequence
  Synthetic oligonucleotide
agcagtgtcacctctgagtgggta

SEQ ID NO: 7324 - DNA, 24 bp, Artificial Sequence
  Synthetic oligonucleotide
agcagcatctatagcgactgaggt

SEQ ID NO: 7325 - DNA, 24 bp, Artificial Sequence
  Synthetic oligonucleotide
agcagtgtctggtttgggggagga

SEQ ID NO: 7326 - DNA, 23 bp, Artificial Sequence
  Synthetic oligonucleotide
agcagagtcggagtgagagaggg

SEQ ID NO: 7327 - DNA, 23 bp, Artificial Sequence
  Synthetic oligonucleotide
agtagcgtctaggcaagtgagca

SEQ ID NO: 7328 - DNA, 23 bp, Artificial Sequence
  Synthetic oligonucleotide
agcagcctctacatgagtgagac

SEQ ID NO: 7329 - DNA, 23 bp, Artificial Sequence
  Synthetic oligonucleotide
agcagtgtcaataagagagtgga

SEQ ID NO: 7330 - DNA, 23 bp, Artificial Sequence
  Synthetic oligonucleotide
agcagcgtttctcaaagtgcgga

SEQ ID NO: 7331 - DNA, 23 bp, Artificial Sequence
  Synthetic oligonucleotide
agcagcgactgtgaaagtgagaa

SEQ ID NO: 7332 - DNA, 23 bp, Artificial Sequence
  Synthetic oligonucleotide
agcagagtccctgtgagtgaagg

SEQ ID NO: 7333 - DNA, 23 bp, Artificial Sequence
  Synthetic oligonucleotide
ggcagcgtcctttccagcgagga

SEQ ID NO: 7334 - DNA, 24 bp, Artificial Sequence
  Synthetic oligonucleotide
agcagggtcaatgtctggtgagga

SEQ ID NO: 7335 - DNA, 23 bp, Artificial Sequence
  Synthetic oligonucleotide
agcagcatcaggctgagtgtggt

SEQ ID NO: 7336 - DNA, 23 bp, Artificial Sequence
  Synthetic oligonucleotide
agcagtgtctcgttaggtgagga

SEQ ID NO: 7337 - DNA, 24 bp, Artificial Sequence
  Synthetic oligonucleotide
agcagggtcagcaaagaatgaggc

SEQ ID NO: 7338 - DNA, 23 bp, Artificial Sequence
  Synthetic oligonucleotide
agcagagtcacaaagaatgagta

SEQ ID NO: 7339 - DNA, 24 bp, Artificial Sequence
  Synthetic oligonucleotide
agcagcgtggggctggagggagaa

SEQ ID NO: 7340 - DNA, 24 bp, Artificial Sequence
  Synthetic oligonucleotide
agcagcgtgttcatggagtgcggc

SEQ ID NO: 7341 - DNA, 24 bp, Artificial Sequence
  Synthetic oligonucleotide
agcagcatctaacaggagggaggg

SEQ ID NO: 7342 - DNA, 23 bp, Artificial Sequence
  Synthetic oligonucleotide
agcagcctcctagggagggaggg

SEQ ID NO: 7343 - DNA, 23 bp, Artificial Sequence
  Synthetic oligonucleotide
agcagcttctgagctagtgaaga

SEQ ID NO: 7344 - DNA, 24 bp, Artificial Sequence
  Synthetic oligonucleotide
atcagcgtctactaagagagtgga

SEQ ID NO: 7345 - DNA, 24 bp, Artificial Sequence
  Synthetic oligonucleotide
agcagcatcacctgcgagggaggg

SEQ ID NO: 7346 - DNA, 23 bp, Artificial Sequence
  Synthetic oligonucleotide
agcagcatcgagttgggtgaggt

SEQ ID NO: 7347 - DNA, 24 bp, Artificial Sequence
  Synthetic oligonucleotide
tgcagcgtccaagctcagtgaggc

SEQ ID NO: 7348 - DNA, 23 bp, Artificial Sequence
  Synthetic oligonucleotide
agcagcttcattttgaatgaggg

SEQ ID NO: 7349 - DNA, 24 bp, Artificial Sequence
  Synthetic oligonucleotide
agcagcctcttttgggagtggggg

SEQ ID NO: 7350 - DNA, 23 bp, Artificial Sequence
  Synthetic oligonucleotide
agcagcgcctcccagagtggggc

SEQ ID NO: 7351 - DNA, 23 bp, Artificial Sequence
  Synthetic oligonucleotide
agcagggtcccccagagaaagga

SEQ ID NO: 7352 - DNA, 23 bp, Artificial Sequence
  Synthetic oligonucleotide
agcagcctcccggagagggaggg

SEQ ID NO: 7353 - DNA, 24 bp, Artificial Sequence
  Synthetic oligonucleotide
ggcagcgtcgggtgggagagagaa

SEQ ID NO: 7354 - DNA, 24 bp, Artificial Sequence
  Synthetic oligonucleotide
agcagagtctaccttgagtgaaaa

SEQ ID NO: 7355 - DNA, 23 bp, Artificial Sequence
  Synthetic oligonucleotide
agcagcgacccaaggagtaagaa

SEQ ID NO: 7356 - DNA, 24 bp, Artificial Sequence
  Synthetic oligonucleotide
agcagtgtctttagaaagtgagca

SEQ ID NO: 7357 - DNA, 23 bp, Artificial Sequence
  Synthetic oligonucleotide
agcagggtcgggcctggtgagga

SEQ ID NO: 7358 - DNA, 24 bp, Artificial Sequence
  Synthetic oligonucleotide
agcagcggctgaatcctgtgagga

SEQ ID NO: 7359 - DNA, 24 bp, Artificial Sequence
  Synthetic oligonucleotide
tgcagcgtctggcatgagtggggc

SEQ ID NO: 7360 - DNA, 23 bp, Artificial Sequence
  Synthetic oligonucleotide
agaagcgtcatgctgagtgaaaa

SEQ ID NO: 7361 - DNA, 24 bp, Artificial Sequence
  Synthetic oligonucleotide
agcagggtccagggagagggaaga

SEQ ID NO: 7362 - DNA, 23 bp, Artificial Sequence
  Synthetic oligonucleotide
agcagcatccctgtgagtgagtg

SEQ ID NO: 7363 - DNA, 24 bp, Artificial Sequence
  Synthetic oligonucleotide
agtagcgtcaatgataagtgtgga

SEQ ID NO: 7364 - DNA, 23 bp, Artificial Sequence
  Synthetic oligonucleotide
agcagggtccaggtaagagagga

SEQ ID NO: 7365 - DNA, 23 bp, Artificial Sequence
  Synthetic oligonucleotide
agcagggtccaggtaagagagga

SEQ ID NO: 7366 - DNA, 23 bp, Artificial Sequence
  Synthetic oligonucleotide
agcagggtccaggtaagagagga

SEQ ID NO: 7367 - DNA, 24 bp, Artificial Sequence
  Synthetic oligonucleotide
agcaacctcaccccagagagagga

SEQ ID NO: 7368 - DNA, 24 bp, Artificial Sequence
  Synthetic oligonucleotide
agcaacgtgtgttgggagagagga

SEQ ID NO: 7369 - DNA, 24 bp, Artificial Sequence
  Synthetic oligonucleotide
atcagggtcaggttttagtgagga

SEQ ID NO: 7370 - DNA, 23 bp, Artificial Sequence
  Synthetic oligonucleotide
agcaaagtctgtatgagtgagca

SEQ ID NO: 7371 - DNA, 24 bp, Artificial Sequence
  Synthetic oligonucleotide
agcagtgtaaaggagtagtgagga

SEQ ID NO: 7372 - DNA, 24 bp, Artificial Sequence
  Synthetic oligonucleotide
agcagagtaaagcaggtgtgagga

SEQ ID NO: 7373 - DNA, 23 bp, Artificial Sequence
  Synthetic oligonucleotide
agcagcctgggagagagtgaggg

SEQ ID NO: 7374 - DNA, 24 bp, Artificial Sequence
  Synthetic oligonucleotide
agcaacctcctgggtgagagagga

SEQ ID NO: 7375 - DNA, 24 bp, Artificial Sequence
  Synthetic oligonucleotide
aacagcttcagtacacagtgagga

SEQ ID NO: 7376 - DNA, 24 bp, Artificial Sequence
  Synthetic oligonucleotide
agtagtgtcaatgaagagtgaaga

SEQ ID NO: 7377 - DNA, 24 bp, Artificial Sequence
  Synthetic oligonucleotide
atcagggtctagggagagtgtgga

SEQ ID NO: 7378 - DNA, 23 bp, Artificial Sequence
  Synthetic oligonucleotide
ggcagggtccccgggagggagga

SEQ ID NO: 7379 - DNA, 24 bp, Artificial Sequence
  Synthetic oligonucleotide
agctgggtctgaagggtgtgagga

SEQ ID NO: 7380 - DNA, 23 bp, Artificial Sequence
  Synthetic oligonucleotide
agctgggtcctcaggagagagga

SEQ ID NO: 7381 - DNA, 24 bp, Artificial Sequence
  Synthetic oligonucleotide
agcagctccagggccgagtgagaa

SEQ ID NO: 7382 - DNA, 24 bp, Artificial Sequence
  Synthetic oligonucleotide
agcaacatccgctctgagtgggga

SEQ ID NO: 7383 - DNA, 23 bp, Artificial Sequence
  Synthetic oligonucleotide
aacagcttcacaggcagtgagga

SEQ ID NO: 7384 - DNA, 24 bp, Artificial Sequence
  Synthetic oligonucleotide
atcagcgcccaacaccagtgagga

SEQ ID NO: 7385 - DNA, 23 bp, Artificial Sequence
  Synthetic oligonucleotide
agcaggggcagtgggagtgagta

SEQ ID NO: 7386 - DNA, 23 bp, Artificial Sequence
  Synthetic oligonucleotide
agcatggtctggttgggtgagga

SEQ ID NO: 7387 - DNA, 24 bp, Artificial Sequence
  Synthetic oligonucleotide
ggcagcgtgctctgagagagagga

SEQ ID NO: 7388 - DNA, 23 bp, Artificial Sequence
  Synthetic oligonucleotide
agcagagccccctggagtgaggg

SEQ ID NO: 7389 - DNA, 24 bp, Artificial Sequence
  Synthetic oligonucleotide
agcaccgtgcttcaaaagtgagga

SEQ ID NO: 7390 - DNA, 23 bp, Artificial Sequence
  Synthetic oligonucleotide
cccagcgtcagcaggagtcagga

SEQ ID NO: 7391 - DNA, 24 bp, Artificial Sequence
  Synthetic oligonucleotide
aggagcgtggacacagagtgaggt

SEQ ID NO: 7392 - DNA, 24 bp, Artificial Sequence
  Synthetic oligonucleotide
agccgagtctgtcccgagtgtgga

SEQ ID NO: 7393 - DNA, 24 bp, Artificial Sequence
  Synthetic oligonucleotide
agtagagtctctgttgagtgagta

SEQ ID NO: 7394 - DNA, 23 bp, Artificial Sequence
  Synthetic oligonucleotide
accagggtcatggcaagtgagga

SEQ ID NO: 7395 - DNA, 24 bp, Artificial Sequence
  Synthetic oligonucleotide
tgcagggtcagattgaagtgagga

SEQ ID NO: 7396 - DNA, 24 bp, Artificial Sequence
  Synthetic oligonucleotide
agcagcggggagagagagcgagga

SEQ ID NO: 7397 - DNA, 23 bp, Artificial Sequence
  Synthetic oligonucleotide
tgcagcgccgaggtgagtgaggg

SEQ ID NO: 7398 - DNA, 23 bp, Artificial Sequence
  Synthetic oligonucleotide
agtagagtctggctgagggagga

SEQ ID NO: 7399 - DNA, 23 bp, Artificial Sequence
  Synthetic oligonucleotide
tgcagcgccgaggtgagtgaggg

SEQ ID NO: 7400 - DNA, 24 bp, Artificial Sequence
  Synthetic oligonucleotide
agtagggtcacactagagtgaaga

SEQ ID NO: 7401 - DNA, 23 bp, Artificial Sequence
  Synthetic oligonucleotide
tgcagcgccgaggtgagtgaggg

SEQ ID NO: 7402 - DNA, 23 bp, Artificial Sequence
  Synthetic oligonucleotide
tgcagcgccgaggtgagtgaggg

SEQ ID NO: 7403 - DNA, 23 bp, Artificial Sequence
  Synthetic oligonucleotide
tgcagcgccgaggtgagtgaggg

SEQ ID NO: 7404 - DNA, 23 bp, Artificial Sequence
  Synthetic oligonucleotide
tgcagcgccgaggtgagtgaggg

SEQ ID NO: 7405 - DNA, 23 bp, Artificial Sequence
  Synthetic oligonucleotide
tgcagcgccgaggtgagtgaggg

SEQ ID NO: 7406 - DNA, 23 bp, Artificial Sequence
  Synthetic oligonucleotide
tgcagcgccgaggtgagtgaggg

SEQ ID NO: 7407 - DNA, 24 bp, Artificial Sequence
  Synthetic oligonucleotide
agcagggtaaagcaagagtgagaa

SEQ ID NO: 7408 - DNA, 24 bp, Artificial Sequence
  Synthetic oligonucleotide
agcagcggggaccgggagcgagga

SEQ ID NO: 7409 - DNA, 24 bp, Artificial Sequence
  Synthetic oligonucleotide
agcaggttcagtgtctagtgagga

SEQ ID NO: 7410 - DNA, 24 bp, Artificial Sequence
  Synthetic oligonucleotide
ggcatcgtctgcagtaagtgagga

SEQ ID NO: 7411 - DNA, 24 bp, Artificial Sequence
  Synthetic oligonucleotide
aatagcgtcagccccaagtgagga

SEQ ID NO: 7412 - DNA, 23 bp, Artificial Sequence
  Synthetic oligonucleotide
agcagcatggtatggagggagga

SEQ ID NO: 7413 - DNA, 23 bp, Artificial Sequence
  Synthetic oligonucleotide
agcagcctgctgcagagtgaggg

SEQ ID NO: 7414 - DNA, 23 bp, Artificial Sequence
  Synthetic oligonucleotide
ggcagcgtggtggtgagagagga

SEQ ID NO: 7415 - DNA, 24 bp, Artificial Sequence
  Synthetic oligonucleotide
agcagagttggtgtctagtgagga

SEQ ID NO: 7416 - DNA, 23 bp, Artificial Sequence
  Synthetic oligonucleotide
aacagagtcgggaagagtaagga

SEQ ID NO: 7417 - DNA, 23 bp, Artificial Sequence
  Synthetic oligonucleotide
aacagcggcgtcctgagtgtgga

SEQ ID NO: 7418 - DNA, 23 bp, Artificial Sequence
  Synthetic oligonucleotide
agcagggtgtgagagagggagga

SEQ ID NO: 7419 - DNA, 23 bp, Artificial Sequence
  Synthetic oligonucleotide
agctgcatcaaacttagtgagga

SEQ ID NO: 7420 - DNA, 23 bp, Artificial Sequence
  Synthetic oligonucleotide
ggcagggtctcccggagggagga

SEQ ID NO: 7421 - DNA, 23 bp, Artificial Sequence
  Synthetic oligonucleotide
agcagcttttcagagagtgaaga

SEQ ID NO: 7422 - DNA, 23 bp, Artificial Sequence
  Synthetic oligonucleotide
agcagggccctgctgagtgaggg

SEQ ID NO: 7423 - DNA, 23 bp, Artificial Sequence
  Synthetic oligonucleotide
agcagggccctgctgagtgaggg

SEQ ID NO: 7424 - DNA, 23 bp, Artificial Sequence
  Synthetic oligonucleotide
ggcagcgttgggatgtgtgagga

SEQ ID NO: 7425 - DNA, 23 bp, Artificial Sequence
  Synthetic oligonucleotide
aacagagtcacagtgagtaagga

SEQ ID NO: 7426 - DNA, 23 bp, Artificial Sequence
  Synthetic oligonucleotide
agcagggccgggcagagtgaggg

SEQ ID NO: 7427 - DNA, 23 bp, Artificial Sequence
  Synthetic oligonucleotide
gggagcgtctgccccagtgagga

SEQ ID NO: 7428 - DNA, 24 bp, Artificial Sequence
  Synthetic oligonucleotide
atcagtgtctaaaatgggtgagga

SEQ ID NO: 7429 - DNA, 23 bp, Artificial Sequence
  Synthetic oligonucleotide
agcggcttctgcctgagtgaggg

SEQ ID NO: 7430 - DNA, 24 bp, Artificial Sequence
  Synthetic oligonucleotide
agcaatgtctgccttgggtgagga

SEQ ID NO: 7431 - DNA, 23 bp, Artificial Sequence
  Synthetic oligonucleotide
agcaaagtcaccaggagtgagca

SEQ ID NO: 7432 - DNA, 24 bp, Artificial Sequence
  Synthetic oligonucleotide
agcaatgtcaatcaggagagagga

SEQ ID NO: 7433 - DNA, 23 bp, Artificial Sequence
  Synthetic oligonucleotide
agcagggtggaaaggaatgagga

SEQ ID NO: 7434 - DNA, 24 bp, Artificial Sequence
  Synthetic oligonucleotide
accagcctcctgagggagtgaggg

SEQ ID NO: 7435 - DNA, 23 bp, Artificial Sequence
  Synthetic oligonucleotide
agaagcggcgttgtaagtgagga

SEQ ID NO: 7436 - DNA, 23 bp, Artificial Sequence
  Synthetic oligonucleotide
agcagtgtggtagacagtgagga

SEQ ID NO: 7437 - DNA, 23 bp, Artificial Sequence
  Synthetic oligonucleotide
agcaatgtcagtctgagttagga

SEQ ID NO: 7438 - DNA, 24 bp, Artificial Sequence
  Synthetic oligonucleotide
agcagggtgttggaggaatgagga

SEQ ID NO: 7439 - DNA, 23 bp, Artificial Sequence
  Synthetic oligonucleotide
agcagcatggaaaagagggagga

SEQ ID NO: 7440 - DNA, 23 bp, Artificial Sequence
  Synthetic oligonucleotide
agcagctttgtagagagtgaaga

SEQ ID NO: 7441 - DNA, 23 bp, Artificial Sequence
  Synthetic oligonucleotide
agcaaggtctgggagagtcagga

SEQ ID NO: 7442 - DNA, 23 bp, Artificial Sequence
  Synthetic oligonucleotide
agcagcctgccaaggagtgaggg

SEQ ID NO: 7443 - DNA, 23 bp, Artificial Sequence
  Synthetic oligonucleotide
agcagtggctaagagagtgagca

SEQ ID NO: 7444 - DNA, 23 bp, Artificial Sequence
  Synthetic oligonucleotide
aacagcgtgtgtgaaagtgagga

SEQ ID NO: 7445 - DNA, 24 bp, Artificial Sequence
  Synthetic oligonucleotide
agcatcctctatgctgtgtgagga

SEQ ID NO: 7446 - DNA, 24 bp, Artificial Sequence
  Synthetic oligonucleotide
agcagagccatgaaggagtgaggc

SEQ ID NO: 7447 - DNA, 23 bp, Artificial Sequence
  Synthetic oligonucleotide
agcagccgcctgagcagtgagga

SEQ ID NO: 7448 - DNA, 23 bp, Artificial Sequence
  Synthetic oligonucleotide
agcagcgagggaggaagtgagga

SEQ ID NO: 7449 - DNA, 23 bp, Artificial Sequence
  Synthetic oligonucleotide
agccgggtcttccgaagtgagga

SEQ ID NO: 7450 - DNA, 24 bp, Artificial Sequence
  Synthetic oligonucleotide
agcctcgtccccagagagggagga

SEQ ID NO: 7451 - DNA, 24 bp, Artificial Sequence
  Synthetic oligonucleotide
aggagagtcccatgagagtgagaa

SEQ ID NO: 7452 - DNA, 24 bp, Artificial Sequence
  Synthetic oligonucleotide
agcaatgtcagataggggtgagga

SEQ ID NO: 7453 - DNA, 24 bp, Artificial Sequence
  Synthetic oligonucleotide
agcatcggcctctctgagtgacga

SEQ ID NO: 7454 - DNA, 23 bp, Artificial Sequence
  Synthetic oligonucleotide
agcatcttcagttgaagtgagga

SEQ ID NO: 7455 - DNA, 24 bp, Artificial Sequence
  Synthetic oligonucleotide
ggcagcgtgtatgatgagagagga

SEQ ID NO: 7456 - DNA, 24 bp, Artificial Sequence
  Synthetic oligonucleotide
agcagggtaaagagtgagtgagaa

SEQ ID NO: 7457 - DNA, 24 bp, Artificial Sequence
  Synthetic oligonucleotide
aacagagtcagcccttagtgagga

SEQ ID NO: 7458 - DNA, 23 bp, Artificial Sequence
  Synthetic oligonucleotide
agcacagtccggatgagtgagca

SEQ ID NO: 7459 - DNA, 24 bp, Artificial Sequence
  Synthetic oligonucleotide
attagcgtcacttagaagtgagga

SEQ ID NO: 7460 - DNA, 23 bp, Artificial Sequence
  Synthetic oligonucleotide
aacagagtcagagatagtgagga

SEQ ID NO: 7461 - DNA, 23 bp, Artificial Sequence
  Synthetic oligonucleotide
agcagcctggcatggagtgaggg

SEQ ID NO: 7462 - DNA, 24 bp, Artificial Sequence
  Synthetic oligonucleotide
aacaccgtcacctgtgggtgagga

SEQ ID NO: 7463 - DNA, 23 bp, Artificial Sequence
  Synthetic oligonucleotide
agcagcggaaataagggtgagga

SEQ ID NO: 7464 - DNA, 24 bp, Artificial Sequence
  Synthetic oligonucleotide
ggcagcgtgaacccagagtgagta

SEQ ID NO: 7465 - DNA, 24 bp, Artificial Sequence
  Synthetic oligonucleotide
aacaccgtcctgccagtgtgagga

SEQ ID NO: 7466 - DNA, 23 bp, Artificial Sequence
  Synthetic oligonucleotide
agcagcgatgttgtaagtgagga

SEQ ID NO: 7467 - DNA, 24 bp, Artificial Sequence
  Synthetic oligonucleotide
agcagggtgggaaaggagggagga

SEQ ID NO: 7468 - DNA, 24 bp, Artificial Sequence
  Synthetic oligonucleotide
agctgggtcagaggtgagagagga

SEQ ID NO: 7469 - DNA, 23 bp, Artificial Sequence
  Synthetic oligonucleotide
agcagctccagggagagtgagaa

SEQ ID NO: 7470 - DNA, 24 bp, Artificial Sequence
  Synthetic oligonucleotide
agcaatgtcttccttgggtgagga

SEQ ID NO: 7471 - DNA, 24 bp, Artificial Sequence
  Synthetic oligonucleotide
agcacagtctgaacagagtgagca

SEQ ID NO: 7472 - DNA, 24 bp, Artificial Sequence
  Synthetic oligonucleotide
agcagcggaggatctgggtgagga

SEQ ID NO: 7473 - DNA, 23 bp, Artificial Sequence
  Synthetic oligonucleotide
agcagcttttgggagagtgagca

SEQ ID NO: 7474 - DNA, 24 bp, Artificial Sequence
  Synthetic oligonucleotide
agcagcgatttgaagaagtgagga

SEQ ID NO: 7475 - DNA, 23 bp, Artificial Sequence
  Synthetic oligonucleotide
agcagcagcacaaagagtgagta

SEQ ID NO: 7476 - DNA, 24 bp, Artificial Sequence
  Synthetic oligonucleotide
aggagcggcaggtgatagtgagga

SEQ ID NO: 7477 - DNA, 23 bp, Artificial Sequence
  Synthetic oligonucleotide
agcacggtccaaaggagagagga

SEQ ID NO: 7478 - DNA, 24 bp, Artificial Sequence
  Synthetic oligonucleotide
agctgggtcattccccagtgagga

SEQ ID NO: 7479 - DNA, 24 bp, Artificial Sequence
  Synthetic oligonucleotide
agctgagtcagccaagtgtgagga

SEQ ID NO: 7480 - DNA, 24 bp, Artificial Sequence
  Synthetic oligonucleotide
agtagggtcaacgttgagtgaaga

SEQ ID NO: 7481 - DNA, 24 bp, Artificial Sequence
  Synthetic oligonucleotide
agtagagtcaacagtgagtgatga

SEQ ID NO: 7482 - DNA, 23 bp, Artificial Sequence
  Synthetic oligonucleotide
aggagagtcgctctgagtgagaa

SEQ ID NO: 7483 - DNA, 23 bp, Artificial Sequence
  Synthetic oligonucleotide
agcgccgtctctggaagtgagga

SEQ ID NO: 7484 - DNA, 24 bp, Artificial Sequence
  Synthetic oligonucleotide
agctgtgtccctcctgagggagga

SEQ ID NO: 7485 - DNA, 24 bp, Artificial Sequence
  Synthetic oligonucleotide
agctgcctccgtggggagtgaggc

SEQ ID NO: 7486 - DNA, 23 bp, Artificial Sequence
  Synthetic oligonucleotide
agcagcctgctgcagagtgaggg

SEQ ID NO: 7487 - DNA, 23 bp, Artificial Sequence
  Synthetic oligonucleotide
agcagcctgctgcagagtgaggg

SEQ ID NO: 7488 - DNA, 23 bp, Artificial Sequence
  Synthetic oligonucleotide
ggcagagtcgtgcatagtgagga

SEQ ID NO: 7489 - DNA, 24 bp, Artificial Sequence
  Synthetic oligonucleotide
agcattgtcaatattgactgagga

SEQ ID NO: 7490 - DNA, 23 bp, Artificial Sequence
  Synthetic oligonucleotide
agcagggtgggtaagagtgagaa

SEQ ID NO: 7491 - DNA, 23 bp, Artificial Sequence
  Synthetic oligonucleotide
ggcagggtctctgggagggagga

SEQ ID NO: 7492 - DNA, 23 bp, Artificial Sequence
  Synthetic oligonucleotide
agtagagtccagtagagtgatga

SEQ ID NO: 7493 - DNA, 23 bp, Artificial Sequence
  Synthetic oligonucleotide
agcagggccctgctgagtgaggg

SEQ ID NO: 7494 - DNA, 23 bp, Artificial Sequence
  Synthetic oligonucleotide
agcaaagtctttaggagagagga

SEQ ID NO: 7495 - DNA, 23 bp, Artificial Sequence
  Synthetic oligonucleotide
agcagtgccctgaagagtgagaa

SEQ ID NO: 7496 - DNA, 24 bp, Artificial Sequence
  Synthetic oligonucleotide
ggcagggtccgagcccagtgagga

SEQ ID NO: 7497 - DNA, 23 bp, Artificial Sequence
  Synthetic oligonucleotide
agctgggtctggctgagtgtgga

SEQ ID NO: 7498 - DNA, 23 bp, Artificial Sequence
  Synthetic oligonucleotide
agcagctttcatggaagtgagga

SEQ ID NO: 7499 - DNA, 23 bp, Artificial Sequence
  Synthetic oligonucleotide
atcatcgtcatcgtgagagagga

SEQ ID NO: 7500 - DNA, 23 bp, Artificial Sequence
  Synthetic oligonucleotide
agccgcgtgagggcaagtgagga

SEQ ID NO: 7501 - DNA, 24 bp, Artificial Sequence
  Synthetic oligonucleotide
agcagggtgggcaaggagggagga

SEQ ID NO: 7502 - DNA, 24 bp, Artificial Sequence
  Synthetic oligonucleotide
agcatggtcaagtttgggtgagga

SEQ ID NO: 7503 - DNA, 23 bp, Artificial Sequence
  Synthetic oligonucleotide
atcagagtcagagaaagtgagga

SEQ ID NO: 7504 - DNA, 23 bp, Artificial Sequence
  Synthetic oligonucleotide
agcagtggcagaataagtgagga

SEQ ID NO: 7505 - DNA, 23 bp, Artificial Sequence
  Synthetic oligonucleotide
aggagtgtctgcaaaagtgagga

SEQ ID NO: 7506 - DNA, 23 bp, Artificial Sequence
  Synthetic oligonucleotide
tgcagggtcaagccaagtgagga

SEQ ID NO: 7507 - DNA, 24 bp, Artificial Sequence
  Synthetic oligonucleotide
agcaggttcagtgtctagtgagga

SEQ ID NO: 7508 - DNA, 23 bp, Artificial Sequence
  Synthetic oligonucleotide
agcagcggaaataagggtgagga

SEQ ID NO: 7509 - DNA, 23 bp, Artificial Sequence
  Synthetic oligonucleotide
agcagggtgctcgggagggagga

SEQ ID NO: 7510 - DNA, 24 bp, Artificial Sequence
  Synthetic oligonucleotide
agcaacctccccacagagggagga

SEQ ID NO: 7511 - DNA, 23 bp, Artificial Sequence
  Synthetic oligonucleotide
agcagggtgggggagagggagga

SEQ ID NO: 7512 - DNA, 24 bp, Artificial Sequence
  Synthetic oligonucleotide
agcaacctctgctcagagagagga

SEQ ID NO: 7513 - DNA, 23 bp, Artificial Sequence
  Synthetic oligonucleotide
tgcagggtctgcggaagtgagga

SEQ ID NO: 7514 - DNA, 24 bp, Artificial Sequence
  Synthetic oligonucleotide
agcaggttcagactgaagtgagga

SEQ ID NO: 7515 - DNA, 23 bp, Artificial Sequence
  Synthetic oligonucleotide
agcaatgtcaccatgagtgtgga

SEQ ID NO: 7516 - DNA, 24 bp, Artificial Sequence
  Synthetic oligonucleotide
agcacggtccccaaggagggagga

SEQ ID NO: 7517 - DNA, 23 bp, Artificial Sequence
  Synthetic oligonucleotide
agcagcgctcgggcgagcgagga

SEQ ID NO: 7518 - DNA, 24 bp, Artificial Sequence
  Synthetic oligonucleotide
agcagggactggtcagagtgaggt

SEQ ID NO: 7519 - DNA, 24 bp, Artificial Sequence
  Synthetic oligonucleotide
agcagccacacaatccagtgagga

SEQ ID NO: 7520 - DNA, 24 bp, Artificial Sequence
  Synthetic oligonucleotide
agtagagtcaagagggagtgagta

SEQ ID NO: 7521 - DNA, 23 bp, Artificial Sequence
  Synthetic oligonucleotide
agcctcgtcttggtgagggagga

SEQ ID NO: 7522 - DNA, 24 bp, Artificial Sequence
  Synthetic oligonucleotide
ggcagcggcctggaggggtgagga

SEQ ID NO: 7523 - DNA, 24 bp, Artificial Sequence
  Synthetic oligonucleotide
agcagagttggtttctagtgagga

SEQ ID NO: 7524 - DNA, 23 bp, Artificial Sequence
  Synthetic oligonucleotide
agcatcttcacctgaagtgagga

SEQ ID NO: 7525 - DNA, 23 bp, Artificial Sequence
  Synthetic oligonucleotide
agcaacatcataatgagtgggga

SEQ ID NO: 7526 - DNA, 23 bp, Artificial Sequence
  Synthetic oligonucleotide
agcacagtccctaagagtgagca

SEQ ID NO: 7527 - DNA, 23 bp, Artificial Sequence
  Synthetic oligonucleotide
aggagtttccagttgagtgagga

SEQ ID NO: 7528 - DNA, 23 bp, Artificial Sequence
  Synthetic oligonucleotide
ggcagcagccatcagagtgagga

SEQ ID NO: 7529 - DNA, 24 bp, Artificial Sequence
  Synthetic oligonucleotide
agcaggttgttggaggagtgagga

SEQ ID NO: 7530 - DNA, 23 bp, Artificial Sequence
  Synthetic oligonucleotide
aacagtgccctggtgagtgagga

SEQ ID NO: 7531 - DNA, 24 bp, Artificial Sequence
  Synthetic oligonucleotide
tggagcgtggggggagagtgagga

SEQ ID NO: 7532 - DNA, 24 bp, Artificial Sequence
  Synthetic oligonucleotide
tggagcgtggaagaggagtgagga

SEQ ID NO: 7533 - DNA, 23 bp, Artificial Sequence
  Synthetic oligonucleotide
agctgaggcacagggagtgagga

SEQ ID NO: 7534 - DNA, 24 bp, Artificial Sequence
  Synthetic oligonucleotide
tgcagggtggacccagagtgagga

SEQ ID NO: 7535 - DNA, 23 bp, Artificial Sequence
  Synthetic oligonucleotide
aacagagtgaggctgagtgagga

SEQ ID NO: 7536 - DNA, 23 bp, Artificial Sequence
  Synthetic oligonucleotide
agcaacttattgctgagtgagga

SEQ ID NO: 7537 - DNA, 24 bp, Artificial Sequence
  Synthetic oligonucleotide
agcacaatctttttggagtgagga

SEQ ID NO: 7538 - DNA, 24 bp, Artificial Sequence
  Synthetic oligonucleotide
tggagggtcggtggagagtgagga

SEQ ID NO: 7539 - DNA, 24 bp, Artificial Sequence
  Synthetic oligonucleotide
agccgtgtggctacggagtgagga

SEQ ID NO: 7540 - DNA, 24 bp, Artificial Sequence
  Synthetic oligonucleotide
tgctgcttctgccgtgagtgagga

SEQ ID NO: 7541 - DNA, 23 bp, Artificial Sequence
  Synthetic oligonucleotide
aacagagtaacacagagtgagga

SEQ ID NO: 7542 - DNA, 23 bp, Artificial Sequence
  Synthetic oligonucleotide
accaacttcatgtagagtgagga

SEQ ID NO: 7543 - DNA, 23 bp, Artificial Sequence
  Synthetic oligonucleotide
aggagagtgagtgtgagtgagga

SEQ ID NO: 7544 - DNA, 24 bp, Artificial Sequence
  Synthetic oligonucleotide
ggcagggtggcgaaggagtgagga

SEQ ID NO: 7545 - DNA, 24 bp, Artificial Sequence
  Synthetic oligonucleotide
ggcagggtggccggggagtgagga

SEQ ID NO: 7546 - DNA, 24 bp, Artificial Sequence
  Synthetic oligonucleotide
agcagggctcctggtgagtgagga

SEQ ID NO: 7547 - DNA, 24 bp, Artificial Sequence
  Synthetic oligonucleotide
tacagtgtcagcagtgagtgagga

SEQ ID NO: 7548 - DNA, 24 bp, Artificial Sequence
  Synthetic oligonucleotide
atcaccttctttcatgagtgagga

SEQ ID NO: 7549 - DNA, 24 bp, Artificial Sequence
  Synthetic oligonucleotide
ttcagtgtctgacgggagtgagga

SEQ ID NO: 7550 - DNA, 24 bp, Artificial Sequence
  Synthetic oligonucleotide
agcagctcaggttaggagtgagga

SEQ ID NO: 7551 - DNA, 23 bp, Artificial Sequence
  Synthetic oligonucleotide
aggagagtagggctgagtgagga

SEQ ID NO: 7552 - DNA, 24 bp, Artificial Sequence
  Synthetic oligonucleotide
acctgggtctgagcagagtgagga

SEQ ID NO: 7553 - DNA, 23 bp, Artificial Sequence
  Synthetic oligonucleotide
atcagtgtgtttttgagtgagga

SEQ ID NO: 7554 - DNA, 24 bp, Artificial Sequence
  Synthetic oligonucleotide
tggagggtcagaggagagtgagga

SEQ ID NO: 7555 - DNA, 23 bp, Artificial Sequence
  Synthetic oligonucleotide
ggcagggtgcgagggagtgagga

SEQ ID NO: 7556 - DNA, 23 bp, Artificial Sequence
  Synthetic oligonucleotide
aggagagtgaatgtgagtgagga

SEQ ID NO: 7557 - DNA, 23 bp, Artificial Sequence
  Synthetic oligonucleotide
agcagtgcacccaagagtgagga

SEQ ID NO: 7558 - DNA, 24 bp, Artificial Sequence
  Synthetic oligonucleotide
agcaggttgaagactgagtgagga

SEQ ID NO: 7559 - DNA, 24 bp, Artificial Sequence
  Synthetic oligonucleotide
aggagagtgagaagtgagtgagga

SEQ ID NO: 7560 - DNA, 24 bp, Artificial Sequence
  Synthetic oligonucleotide
agcagccgtaacaaagagtgagga

SEQ ID NO: 7561 - DNA, 23 bp, Artificial Sequence
  Synthetic oligonucleotide
agcagggcagggcagagtgagga

SEQ ID NO: 7562 - DNA, 23 bp, Artificial Sequence
  Synthetic oligonucleotide
gccagcctcaggctgagtgagga

SEQ ID NO: 7563 - DNA, 24 bp, Artificial Sequence
  Synthetic oligonucleotide
agcagggcttggtgggagtgagga

SEQ ID NO: 7564 - DNA, 23 bp, Artificial Sequence
  Synthetic oligonucleotide
agtagcaactattagagtgagga

SEQ ID NO: 7565 - DNA, 23 bp, Artificial Sequence
  Synthetic oligonucleotide
aacagcggagatttgagtgagga

SEQ ID NO: 7566 - DNA, 23 bp, Artificial Sequence
  Synthetic oligonucleotide
aggaccatccgagagagtgagga

SEQ ID NO: 7567 - DNA, 23 bp, Artificial Sequence
  Synthetic oligonucleotide
aggaccatcccagggagtgagga

SEQ ID NO: 7568 - DNA, 23 bp, Artificial Sequence
  Synthetic oligonucleotide
aggaccatcccagggagtgagga

SEQ ID NO: 7569 - DNA, 23 bp, Artificial Sequence
  Synthetic oligonucleotide
aggaccatcccagggagtgagga

SEQ ID NO: 7570 - DNA, 23 bp, Artificial Sequence
  Synthetic oligonucleotide
agcaggttaacagggagtgagga

SEQ ID NO: 7571 - DNA, 23 bp, Artificial Sequence
  Synthetic oligonucleotide
tgcagggtgagcctgagtgagga

SEQ ID NO: 7572 - DNA, 23 bp, Artificial Sequence
  Synthetic oligonucleotide
agaagggtagaaaggagtgagga

SEQ ID NO: 7573 - DNA, 23 bp, Artificial Sequence
  Synthetic oligonucleotide
agatgcggccagtagagtgagga

SEQ ID NO: 7574 - DNA, 24 bp, Artificial Sequence
  Synthetic oligonucleotide
aatagggtcaggtaggagtgagga

SEQ ID NO: 7575 - DNA, 23 bp, Artificial Sequence
  Synthetic oligonucleotide
agcagtgaaggtgggagtgagga

SEQ ID NO: 7576 - DNA, 23 bp, Artificial Sequence
  Synthetic oligonucleotide
agaaacgtggaaaagagtgagga

SEQ ID NO: 7577 - DNA, 23 bp, Artificial Sequence
  Synthetic oligonucleotide
aacagggaccttatgagtgagga

SEQ ID NO: 7578 - DNA, 23 bp, Artificial Sequence
  Synthetic oligonucleotide
agcaaggacttaaagagtgagga

SEQ ID NO: 7579 - DNA, 23 bp, Artificial Sequence
  Synthetic oligonucleotide
agcagatgcccttggagtgagga

SEQ ID NO: 7580 - DNA, 23 bp, Artificial Sequence
  Synthetic oligonucleotide
agcagctgtgcatagagtgagga

SEQ ID NO: 7581 - DNA, 24 bp, Artificial Sequence
  Synthetic oligonucleotide
agaagggtttgtgcagagtgagga

SEQ ID NO: 7582 - DNA, 23 bp, Artificial Sequence
  Synthetic oligonucleotide
aacagagtggtttagagtgagga

SEQ ID NO: 7583 - DNA, 23 bp, Artificial Sequence
  Synthetic oligonucleotide
ggcagtggcagtgggagtgagga

SEQ ID NO: 7584 - DNA, 23 bp, Artificial Sequence
  Synthetic oligonucleotide
agcaccgagcccctgagtgagga

SEQ ID NO: 7585 - DNA, 23 bp, Artificial Sequence
  Synthetic oligonucleotide
atcagcatgaaatggagtgagga

SEQ ID NO: 7586 - DNA, 23 bp, Artificial Sequence
  Synthetic oligonucleotide
agctgtgtgaccctgagtgagga

SEQ ID NO: 7587 - DNA, 24 bp, Artificial Sequence
  Synthetic oligonucleotide
tgcagggtgggaatagagtgagga

SEQ ID NO: 7588 - DNA, 23 bp, Artificial Sequence
  Synthetic oligonucleotide
tgcagggtgtagtggagtgagga

SEQ ID NO: 7589 - DNA, 24 bp, Artificial Sequence
  Synthetic oligonucleotide
aggaggttctgggaggagtgagga

SEQ ID NO: 7590 - DNA, 24 bp, Artificial Sequence
  Synthetic oligonucleotide
aggaatgtcctggtcgagtgagga

SEQ ID NO: 7591 - DNA, 24 bp, Artificial Sequence
  Synthetic oligonucleotide
agtagctgcctttgggagtgagga

SEQ ID NO: 7592 - DNA, 24 bp, Artificial Sequence
  Synthetic oligonucleotide
agaagggtgggaggggagtgagga

SEQ ID NO: 7593 - DNA, 24 bp, Artificial Sequence
  Synthetic oligonucleotide
agtagctgcctttgggagtgagga

SEQ ID NO: 7594 - DNA, 24 bp, Artificial Sequence
  Synthetic oligonucleotide
agtagctgcctttgggagtgagga

SEQ ID NO: 7595 - DNA, 24 bp, Artificial Sequence
  Synthetic oligonucleotide
agtagctgcctttgggagtgagga

SEQ ID NO: 7596 - DNA, 24 bp, Artificial Sequence
  Synthetic oligonucleotide
agtagctgcctttgggagtgagga

SEQ ID NO: 7597 - DNA, 24 bp, Artificial Sequence
  Synthetic oligonucleotide
agtagctgcctttgggagtgagga

SEQ ID NO: 7598 - DNA, 24 bp, Artificial Sequence
  Synthetic oligonucleotide
agtagctgcctttgggagtgagga

SEQ ID NO: 7599 - DNA, 24 bp, Artificial Sequence
  Synthetic oligonucleotide
agtagctgcctttgggagtgagga

SEQ ID NO: 7600 - DNA, 23 bp, Artificial Sequence
  Synthetic oligonucleotide
agtagaggctggaggagtgagga

SEQ ID NO: 7601 - DNA, 24 bp, Artificial Sequence
  Synthetic oligonucleotide
ggcagcagcaatagagagtgagga

SEQ ID NO: 7602 - DNA, 24 bp, Artificial Sequence
  Synthetic oligonucleotide
agcagcacaagcactgagtgagga

SEQ ID NO: 7603 - DNA, 23 bp, Artificial Sequence
  Synthetic oligonucleotide
tgcatcgtaagcatgagtgagga

SEQ ID NO: 7604 - DNA, 23 bp, Artificial Sequence
  Synthetic oligonucleotide
ggcagggtgggggtgagtgagga

SEQ ID NO: 7605 - DNA, 24 bp, Artificial Sequence
  Synthetic oligonucleotide
agcagctgaaagagggagtgagga

SEQ ID NO: 7606 - DNA, 24 bp, Artificial Sequence
  Synthetic oligonucleotide
tggagcgtgggaggagagtgagga

SEQ ID NO: 7607 - DNA, 24 bp, Artificial Sequence
  Synthetic oligonucleotide
tccagggtcactaatgagtgagga

SEQ ID NO: 7608 - DNA, 23 bp, Artificial Sequence
  Synthetic oligonucleotide
tgcagcgaaaggcagagtgagga

SEQ ID NO: 7609 - DNA, 23 bp, Artificial Sequence
  Synthetic oligonucleotide
agcaggttggggaagagtgagga

SEQ ID NO: 7610 - DNA, 23 bp, Artificial Sequence
  Synthetic oligonucleotide
agctgaggctggcagagtgagga

SEQ ID NO: 7611 - DNA, 24 bp, Artificial Sequence
  Synthetic oligonucleotide
aacagtggcaaatgagagtgagga

SEQ ID NO: 7612 - DNA, 24 bp, Artificial Sequence
  Synthetic oligonucleotide
ggcagtgcctgaagggagtgagga

SEQ ID NO: 7613 - DNA, 24 bp, Artificial Sequence
  Synthetic oligonucleotide
ggcagtgcctgaagggagtgagga

SEQ ID NO: 7614 - DNA, 24 bp, Artificial Sequence
  Synthetic oligonucleotide
ggcagtgcctgaagggagtgagga

SEQ ID NO: 7615 - DNA, 23 bp, Artificial Sequence
  Synthetic oligonucleotide
aggagagtatggaggagtgagga

SEQ ID NO: 7616 - DNA, 24 bp, Artificial Sequence
  Synthetic oligonucleotide
cgcagcattgcagcggagtgagga

SEQ ID NO: 7617 - DNA, 24 bp, Artificial Sequence
  Synthetic oligonucleotide
ggaagtgtccttcaagagtgagga

SEQ ID NO: 7618 - DNA, 24 bp, Artificial Sequence
  Synthetic oligonucleotide
agctgcataaggaaagagtgagga

SEQ ID NO: 7619 - DNA, 24 bp, Artificial Sequence
  Synthetic oligonucleotide
actagggtctttggagagtgagga

SEQ ID NO: 7620 - DNA, 23 bp, Artificial Sequence
  Synthetic oligonucleotide
agctgtgtgccagggagtgagga

SEQ ID NO: 7621 - DNA, 24 bp, Artificial Sequence
  Synthetic oligonucleotide
accactgtcagctgtgagtgagga

SEQ ID NO: 7622 - DNA, 23 bp, Artificial Sequence
  Synthetic oligonucleotide
ggtagcttctcctggagtgagga

SEQ ID NO: 7623 - DNA, 24 bp, Artificial Sequence
  Synthetic oligonucleotide
agcagggctgggcaggagtgagga

SEQ ID NO: 7624 - DNA, 24 bp, Artificial Sequence
  Synthetic oligonucleotide
agctgtgtgatgggagagtgagga

SEQ ID NO: 7625 - DNA, 23 bp, Artificial Sequence
  Synthetic oligonucleotide
tgaagagtccaagggagtgagga

SEQ ID NO: 7626 - DNA, 23 bp, Artificial Sequence
  Synthetic oligonucleotide
tgaagagtccaagggagtgagga

SEQ ID NO: 7627 - DNA, 23 bp, Artificial Sequence
  Synthetic oligonucleotide
acgagggtccataggagtgagga

SEQ ID NO: 7628 - DNA, 23 bp, Artificial Sequence
  Synthetic oligonucleotide
agaagcggtggagtgagtgagga

SEQ ID NO: 7629 - DNA, 24 bp, Artificial Sequence
  Synthetic oligonucleotide
ggcagagttgtactggagtgagga

SEQ ID NO: 7630 - DNA, 24 bp, Artificial Sequence
  Synthetic oligonucleotide
agcagttacggcaaagagtgagga

SEQ ID NO: 7631 - DNA, 24 bp, Artificial Sequence
  Synthetic oligonucleotide
tgcagtgtgcaaggagagtgagga

SEQ ID NO: 7632 - DNA, 23 bp, Artificial Sequence
  Synthetic oligonucleotide
ctctgcgtctggaagagtgagga

SEQ ID NO: 7633 - DNA, 24 bp, Artificial Sequence
  Synthetic oligonucleotide
aggagagtgagagaagagtgagga

SEQ ID NO: 7634 - DNA, 24 bp, Artificial Sequence
  Synthetic oligonucleotide
aggagagtgagagaagagtgagga

SEQ ID NO: 7635 - DNA, 24 bp, Artificial Sequence
  Synthetic oligonucleotide
aatagggtcaggtaggagtgagga

SEQ ID NO: 7636 - DNA, 24 bp, Artificial Sequence
  Synthetic oligonucleotide
agcagcgtctccgaagactcatgt

SEQ ID NO: 7637 - DNA, 24 bp, Artificial Sequence
  Synthetic oligonucleotide
agcagcgtcacataatagtggagc

SEQ ID NO: 7638 - DNA, 23 bp, Artificial Sequence
  Synthetic oligonucleotide
agcagcgtccaggagtgggagtc

SEQ ID NO: 7639 - DNA, 24 bp, Artificial Sequence
  Synthetic oligonucleotide
agcagcgtctggtctggcggaggc

SEQ ID NO: 7640 - DNA, 23 bp, Artificial Sequence
  Synthetic oligonucleotide
agcagcgtcttagaaggtgacaa

SEQ ID NO: 7641 - DNA, 24 bp, Artificial Sequence
  Synthetic oligonucleotide
agcagcgtcagaggagggagacca

SEQ ID NO: 7642 - DNA, 24 bp, Artificial Sequence
  Synthetic oligonucleotide
agcagcgtcactggtaagacatga

SEQ ID NO: 7643 - DNA, 23 bp, Artificial Sequence
  Synthetic oligonucleotide
agcagcgtccctggcatggagca

SEQ ID NO: 7644 - DNA, 24 bp, Artificial Sequence
  Synthetic oligonucleotide
agcagcgtctgacagcagtgaaac

SEQ ID NO: 7645 - DNA, 24 bp, Artificial Sequence
  Synthetic oligonucleotide
agcagcgtctccagggtgtgctgc

SEQ ID NO: 7646 - DNA, 23 bp, Artificial Sequence
  Synthetic oligonucleotide
agcagcgtctcagaggtagagca

SEQ ID NO: 7647 - DNA, 24 bp, Artificial Sequence
  Synthetic oligonucleotide
agcagcgtcgagacccatggagca

SEQ ID NO: 7648 - DNA, 23 bp, Artificial Sequence
  Synthetic oligonucleotide
agcagcgtcgtggcagggcagga

SEQ ID NO: 7649 - DNA, 23 bp, Artificial Sequence
  Synthetic oligonucleotide
agcagcgtcctggggagcgcgtc

SEQ ID NO: 7650 - DNA, 24 bp, Artificial Sequence
  Synthetic oligonucleotide
agcagcgtcgttcggggctgagat

SEQ ID NO: 7651 - DNA, 23 bp, Artificial Sequence
  Synthetic oligonucleotide
agcagcgtcaggctgtgggagcc

SEQ ID NO: 7652 - DNA, 23 bp, Artificial Sequence
  Synthetic oligonucleotide
agcagcgtccactgtggtaagca

SEQ ID NO: 7653 - DNA, 24 bp, Artificial Sequence
  Synthetic oligonucleotide
agcagcgtctgcatggtgtgttgc

SEQ ID NO: 7654 - DNA, 24 bp, Artificial Sequence
  Synthetic oligonucleotide
agcagcgtctaatacaattgagtt

SEQ ID NO: 7655 - DNA, 24 bp, Artificial Sequence
  Synthetic oligonucleotide
agcagcgtcaactgtgtgagttga

SEQ ID NO: 7656 - DNA, 24 bp, Artificial Sequence
  Synthetic oligonucleotide
agcagcgtcaagtctgtgtgctgc

SEQ ID NO: 7657 - DNA, 24 bp, Artificial Sequence
  Synthetic oligonucleotide
agcagcgtctacagtgactgccgt

SEQ ID NO: 7658 - DNA, 23 bp, Artificial Sequence
  Synthetic oligonucleotide
agcagcgtctgtgccatggagca

SEQ ID NO: 7659 - DNA, 23 bp, Artificial Sequence
  Synthetic oligonucleotide
agcagcgtctccttgagcggtgc

SEQ ID NO: 7660 - DNA, 24 bp, Artificial Sequence
  Synthetic oligonucleotide
agcagcgtctccttgggcagaggt

SEQ ID NO: 7661 - DNA, 23 bp, Artificial Sequence
  Synthetic oligonucleotide
agcagcgtcacgtgccgctagga

SEQ ID NO: 7662 - DNA, 23 bp, Artificial Sequence
  Synthetic oligonucleotide
agccgcgtcgcggagagggcggc

SEQ ID NO: 7663 - DNA, 24 bp, Artificial Sequence
  Synthetic oligonucleotide
agcagtgtcctgagggtgtgaagg

SEQ ID NO: 7664 - DNA, 23 bp, Artificial Sequence
  Synthetic oligonucleotide
agcagtgtcagattaagtgagcc

SEQ ID NO: 7665 - DNA, 23 bp, Artificial Sequence
  Synthetic oligonucleotide
agcatcgtcaattacagtgaaaa

SEQ ID NO: 7666 - DNA, 23 bp, Artificial Sequence
  Synthetic oligonucleotide
agcagcggctgtggcagtgtggt

SEQ ID NO: 7667 - DNA, 24 bp, Artificial Sequence
  Synthetic oligonucleotide
agcaacgtcgtgacagagcctgga

SEQ ID NO: 7668 - DNA, 23 bp, Artificial Sequence
  Synthetic oligonucleotide
agcagtgtcacagtgtgtgagag

SEQ ID NO: 7669 - DNA, 24 bp, Artificial Sequence
  Synthetic oligonucleotide
agcagcggctcccaggagaggggc

SEQ ID NO: 7670 - DNA, 24 bp, Artificial Sequence
  Synthetic oligonucleotide
agcaacgtcagcaaagtctcagga

SEQ ID NO: 7671 - DNA, 24 bp, Artificial Sequence
  Synthetic oligonucleotide
agcaacgtcagcaaagtctcagga

SEQ ID NO: 7672 - DNA, 23 bp, Artificial Sequence
  Synthetic oligonucleotide
agtagcgtctcgctgtgtgagtg

SEQ ID NO: 7673 - DNA, 24 bp, Artificial Sequence
  Synthetic oligonucleotide
agcaacgtcagcagagtctcagga

SEQ ID NO: 7674 - DNA, 23 bp, Artificial Sequence
  Synthetic oligonucleotide
agcagcgttattctgagtgatat

SEQ ID NO: 7675 - DNA, 23 bp, Artificial Sequence
  Synthetic oligonucleotide
agcagtgtccagtagtgtaaggt

SEQ ID NO: 7676 - DNA, 24 bp, Artificial Sequence
  Synthetic oligonucleotide
agcaacgtcagcaaagtctcagga

SEQ ID NO: 7677 - DNA, 24 bp, Artificial Sequence
  Synthetic oligonucleotide
agcaacgtcagcaaagtctcagga

SEQ ID NO: 7678 - DNA, 24 bp, Artificial Sequence
  Synthetic oligonucleotide
ggcagcgtcgggatatggtgaggg

SEQ ID NO: 7679 - DNA, 24 bp, Artificial Sequence
  Synthetic oligonucleotide
agcaacgtcagcaaagtctcagga

SEQ ID NO: 7680 - DNA, 23 bp, Artificial Sequence
  Synthetic oligonucleotide
agcagagtcgctcactgtgaggc

SEQ ID NO: 7681 - DNA, 24 bp, Artificial Sequence
  Synthetic oligonucleotide
agcagcggcagcggcgagggcggc

SEQ ID NO: 7682 - DNA, 24 bp, Artificial Sequence
  Synthetic oligonucleotide
agcagtgtcagagcagagagagcc

SEQ ID NO: 7683 - DNA, 24 bp, Artificial Sequence
  Synthetic oligonucleotide
agcatcgtctgatccttgtgaggg

SEQ ID NO: 7684 - DNA, 24 bp, Artificial Sequence
  Synthetic oligonucleotide
agcaacgtcagcaaagtctcagga

SEQ ID NO: 7685 - DNA, 24 bp, Artificial Sequence
  Synthetic oligonucleotide
agcaacgtcagcaaagtctcagga

SEQ ID NO: 7686 - DNA, 23 bp, Artificial Sequence
  Synthetic oligonucleotide
agcagggtctcctgtagtgagtc

SEQ ID NO: 7687 - DNA, 24 bp, Artificial Sequence
  Synthetic oligonucleotide
accagcgtctgcttctggtgaggc

SEQ ID NO: 7688 - DNA, 24 bp, Artificial Sequence
  Synthetic oligonucleotide
agcaacgtcagcaaagtctcagga

SEQ ID NO: 7689 - DNA, 23 bp, Artificial Sequence
  Synthetic oligonucleotide
agcagcatcagctggaggaaggg

SEQ ID NO: 7690 - DNA, 24 bp, Artificial Sequence
  Synthetic oligonucleotide
agcagcggcaacgatgagcaagaa

SEQ ID NO: 7691 - DNA, 24 bp, Artificial Sequence
  Synthetic oligonucleotide
agcagtgtcagcagcaagtgtggt

SEQ ID NO: 7692 - DNA, 24 bp, Artificial Sequence
  Synthetic oligonucleotide
agcaacgtcagcaaagtctcagga

SEQ ID NO: 7693 - DNA, 24 bp, Artificial Sequence
  Synthetic oligonucleotide
agcagcggccacagaggttgaggc

SEQ ID NO: 7694 - DNA, 23 bp, Artificial Sequence
  Synthetic oligonucleotide
agcagcggcacctggggagaggc

SEQ ID NO: 7695 - DNA, 24 bp, Artificial Sequence
  Synthetic oligonucleotide
agcagtgtcagtggtggaggagga

SEQ ID NO: 7696 - DNA, 24 bp, Artificial Sequence
  Synthetic oligonucleotide
agcaacgtcagcaaagtctcagga

SEQ ID NO: 7697 - DNA, 24 bp, Artificial Sequence
  Synthetic oligonucleotide
agcagagtcctgggagactgaaca

SEQ ID NO: 7698 - DNA, 23 bp, Artificial Sequence
  Synthetic oligonucleotide
agcagtgtcagatagagggagcc

SEQ ID NO: 7699 - DNA, 24 bp, Artificial Sequence
  Synthetic oligonucleotide
agcagtgtccatttgaagggaggt

SEQ ID NO: 7700 - DNA, 23 bp, Artificial Sequence
  Synthetic oligonucleotide
tgcagcgtctgtgtgagtgtcgt

SEQ ID NO: 7701 - DNA, 23 bp, Artificial Sequence
  Synthetic oligonucleotide
ggcagcgtctgtctgtgtgagct

SEQ ID NO: 7702 - DNA, 24 bp, Artificial Sequence
  Synthetic oligonucleotide
agcagcgtgttttaagagtgaaag

SEQ ID NO: 7703 - DNA, 24 bp, Artificial Sequence
  Synthetic oligonucleotide
agcagcggctgtgaaaggtgaggt

SEQ ID NO: 7704 - DNA, 23 bp, Artificial Sequence
  Synthetic oligonucleotide
agcagtgtccaggaggaggagga

SEQ ID NO: 7705 - DNA, 24 bp, Artificial Sequence
  Synthetic oligonucleotide
agcagtgtcttgcatgtgggaggt

SEQ ID NO: 7706 - DNA, 24 bp, Artificial Sequence
  Synthetic oligonucleotide
accagcgtctgcttctggtgaggc

SEQ ID NO: 7707 - DNA, 24 bp, Artificial Sequence
  Synthetic oligonucleotide
agcaacgtccatcctgagagatgg

SEQ ID NO: 7708 - DNA, 24 bp, Artificial Sequence
  Synthetic oligonucleotide
agcaacgtcagcaaagtctcagga

SEQ ID NO: 7709 - DNA, 24 bp, Artificial Sequence
  Synthetic oligonucleotide
agcaacgtcacaggtgagttgaga

SEQ ID NO: 7710 - DNA, 23 bp, Artificial Sequence
  Synthetic oligonucleotide
agcaacgtccagaaaattgagca

SEQ ID NO: 7711 - DNA, 23 bp, Artificial Sequence
  Synthetic oligonucleotide
agcagtgtctttttgagtaggca

SEQ ID NO: 7712 - DNA, 23 bp, Artificial Sequence
  Synthetic oligonucleotide
agcagcggcagcattagggaggt

SEQ ID NO: 7713 - DNA, 24 bp, Artificial Sequence
  Synthetic oligonucleotide
agcagtgtcctcatgggaggagga

SEQ ID NO: 7714 - DNA, 23 bp, Artificial Sequence
  Synthetic oligonucleotide
agcagcggccaagagagtgaatt

SEQ ID NO: 7715 - DNA, 24 bp, Artificial Sequence
  Synthetic oligonucleotide
agcaacgtcagcaaagtctcagga

SEQ ID NO: 7716 - DNA, 23 bp, Artificial Sequence
  Synthetic oligonucleotide
agcagagtcagggagactgagtc

SEQ ID NO: 7717 - DNA, 24 bp, Artificial Sequence
  Synthetic oligonucleotide
agcagtgtccagcgtgagggagat

SEQ ID NO: 7718 - DNA, 23 bp, Artificial Sequence
  Synthetic oligonucleotide
agcaccgtctgggagtatgaggc

SEQ ID NO: 7719 - DNA, 24 bp, Artificial Sequence
  Synthetic oligonucleotide
accagcgtccacttctggtgaggc

SEQ ID NO: 7720 - DNA, 24 bp, Artificial Sequence
  Synthetic oligonucleotide
agcaacgtcagcaaagtctcagga

SEQ ID NO: 7721 - DNA, 24 bp, Artificial Sequence
  Synthetic oligonucleotide
agcaacgtcagcaaagtctcagga

SEQ ID NO: 7722 - DNA, 24 bp, Artificial Sequence
  Synthetic oligonucleotide
agcaacgtcagaaaagtctcagga

SEQ ID NO: 7723 - DNA, 23 bp, Artificial Sequence
  Synthetic oligonucleotide
agcagggtccaaaagagtgattt

SEQ ID NO: 7724 - DNA, 24 bp, Artificial Sequence
  Synthetic oligonucleotide
agcagtgtcagcccagagtgaatt

SEQ ID NO: 7725 - DNA, 24 bp, Artificial Sequence
  Synthetic oligonucleotide
agcaacgtcagcaaagtctcagga

SEQ ID NO: 7726 - DNA, 24 bp, Artificial Sequence
  Synthetic oligonucleotide
agcaacgtcagcaaagtctcagga

SEQ ID NO: 7727 - DNA, 24 bp, Artificial Sequence
  Synthetic oligonucleotide
agcagtgtcaactaggagtaggca

SEQ ID NO: 7728 - DNA, 23 bp, Artificial Sequence
  Synthetic oligonucleotide
agcagcggcattacgagtaagct

SEQ ID NO: 7729 - DNA, 24 bp, Artificial Sequence
  Synthetic oligonucleotide
agcaacgtcagcaaagtctcagga

SEQ ID NO: 7730 - DNA, 24 bp, Artificial Sequence
  Synthetic oligonucleotide
agcaacgtcaacaaagtctcagga

SEQ ID NO: 7731 - DNA, 23 bp, Artificial Sequence
  Synthetic oligonucleotide
agcagcttcctctggggagtgga

SEQ ID NO: 7732 - DNA, 23 bp, Artificial Sequence
  Synthetic oligonucleotide
agcagtgtctccccgagggaaaa

SEQ ID NO: 7733 - DNA, 23 bp, Artificial Sequence
  Synthetic oligonucleotide
agcatcgtccggggaggtgagaa

SEQ ID NO: 7734 - DNA, 23 bp, Artificial Sequence
  Synthetic oligonucleotide
agcagcggctctcaaagtgtggt

SEQ ID NO: 7735 - DNA, 23 bp, Artificial Sequence
  Synthetic oligonucleotide
agcatcgtccggggaggtgagaa

SEQ ID NO: 7736 - DNA, 24 bp, Artificial Sequence
  Synthetic oligonucleotide
agcagcgttcacactcagagaggt

SEQ ID NO: 7737 - DNA, 24 bp, Artificial Sequence
  Synthetic oligonucleotide
agcagcggccggagcaagagaggg

SEQ ID NO: 7738 - DNA, 23 bp, Artificial Sequence
  Synthetic oligonucleotide
aacagcgtcaatgtgtgtgagag

SEQ ID NO: 7739 - DNA, 23 bp, Artificial Sequence
  Synthetic oligonucleotide
agcatcgtccggggaggtgagaa

SEQ ID NO: 7740 - DNA, 23 bp, Artificial Sequence
  Synthetic oligonucleotide
agcatcgtccggggaggtgagaa

SEQ ID NO: 7741 - DNA, 23 bp, Artificial Sequence
  Synthetic oligonucleotide
agcatcgtctggggaggtgagaa

SEQ ID NO: 7742 - DNA, 23 bp, Artificial Sequence
  Synthetic oligonucleotide
agcatcgtccggggaggtgagaa

SEQ ID NO: 7743 - DNA, 23 bp, Artificial Sequence
  Synthetic oligonucleotide
agcagcatcagcgagaggaaggg

SEQ ID NO: 7744 - DNA, 24 bp, Artificial Sequence
  Synthetic oligonucleotide
agcaacgtcagcaaagtctcagga

SEQ ID NO: 7745 - DNA, 24 bp, Artificial Sequence
  Synthetic oligonucleotide
agcaccgtccagtgtgggtgaagc

SEQ ID NO: 7746 - DNA, 24 bp, Artificial Sequence
  Synthetic oligonucleotide
agcaacgtcagcaaagtctcagga

SEQ ID NO: 7747 - DNA, 23 bp, Artificial Sequence
  Synthetic oligonucleotide
aacagcgtcaacgtgagtgaatt

SEQ ID NO: 7748 - DNA, 24 bp, Artificial Sequence
  Synthetic oligonucleotide
agcaacgtcagcaaagtctcagga

SEQ ID NO: 7749 - DNA, 24 bp, Artificial Sequence
  Synthetic oligonucleotide
agcaacgtcagcaaagtctcagga

SEQ ID NO: 7750 - DNA, 24 bp, Artificial Sequence
  Synthetic oligonucleotide
agcaccgtctcctgagggtgagtg

SEQ ID NO: 7751 - DNA, 24 bp, Artificial Sequence
  Synthetic oligonucleotide
agcaccgtcctttccgtgtggggt

SEQ ID NO: 7752 - DNA, 24 bp, Artificial Sequence
  Synthetic oligonucleotide
agcagggtcaaaaagtagtgttga

SEQ ID NO: 7753 - DNA, 24 bp, Artificial Sequence
  Synthetic oligonucleotide
agcaacgtccctcatgaataaaga

SEQ ID NO: 7754 - DNA, 24 bp, Artificial Sequence
  Synthetic oligonucleotide
agcaacgtcagcaaagtctcagga

SEQ ID NO: 7755 - DNA, 23 bp, Artificial Sequence
  Synthetic oligonucleotide
agcagcttctctgagggagtgga

SEQ ID NO: 7756 - DNA, 24 bp, Artificial Sequence
  Synthetic oligonucleotide
ggcagcgtctgggatgaggaaggc

SEQ ID NO: 7757 - DNA, 24 bp, Artificial Sequence
  Synthetic oligonucleotide
agcaacgtcagcaaagtctcagga

SEQ ID NO: 7758 - DNA, 23 bp, Artificial Sequence
  Synthetic oligonucleotide
agcagcggcaacttaagagtgga

SEQ ID NO: 7759 - DNA, 23 bp, Artificial Sequence
  Synthetic oligonucleotide
agcagcggcctcagaagtgagcc

SEQ ID NO: 7760 - DNA, 24 bp, Artificial Sequence
  Synthetic oligonucleotide
agcagtgtctgcacagagtaggca

SEQ ID NO: 7761 - DNA, 24 bp, Artificial Sequence
  Synthetic oligonucleotide
agcagtgtcccgaggctgtgaggc

SEQ ID NO: 7762 - DNA, 24 bp, Artificial Sequence
  Synthetic oligonucleotide
agcaacgtcagcaaagtctcagga

SEQ ID NO: 7763 - DNA, 24 bp, Artificial Sequence
  Synthetic oligonucleotide
agcaacgtcagcaaagtctcagga

SEQ ID NO: 7764 - DNA, 23 bp, Artificial Sequence
  Synthetic oligonucleotide
agcagtgtccagcacagtgagat

SEQ ID NO: 7765 - DNA, 24 bp, Artificial Sequence
  Synthetic oligonucleotide
agcaacgtccagagggaggaaaga

SEQ ID NO: 7766 - DNA, 24 bp, Artificial Sequence
  Synthetic oligonucleotide
agcagcgtgttaattaagtgagtc

SEQ ID NO: 7767 - DNA, 23 bp, Artificial Sequence
  Synthetic oligonucleotide
agcagggtctaagggagtgattt

SEQ ID NO: 7768 - DNA, 23 bp, Artificial Sequence
  Synthetic oligonucleotide
agcaccgtctgggagtttcagga

SEQ ID NO: 7769 - DNA, 23 bp, Artificial Sequence
  Synthetic oligonucleotide
agcaccgtctgggagtttcagga

SEQ ID NO: 7770 - DNA, 24 bp, Artificial Sequence
  Synthetic oligonucleotide
atcagcgtccagcgtgaggtaggc

SEQ ID NO: 7771 - DNA, 23 bp, Artificial Sequence
  Synthetic oligonucleotide
agcatcgtcaattatagtgagac

SEQ ID NO: 7772 - DNA, 24 bp, Artificial Sequence
  Synthetic oligonucleotide
agcaacgtcagcaaagtctcagga

SEQ ID NO: 7773 - DNA, 23 bp, Artificial Sequence
  Synthetic oligonucleotide
agcagcgacatcctgagtgggct

SEQ ID NO: 7774 - DNA, 24 bp, Artificial Sequence
  Synthetic oligonucleotide
agcaccgtccagacagagcaggga

SEQ ID NO: 7775 - DNA, 24 bp, Artificial Sequence
  Synthetic oligonucleotide
agcagtgtcattttctggtgaggg

SEQ ID NO: 7776 - DNA, 23 bp, Artificial Sequence
  Synthetic oligonucleotide
agcagtgtcctgtggagtgttgg

SEQ ID NO: 7777 - DNA, 23 bp, Artificial Sequence
  Synthetic oligonucleotide
agcagcggcgaggttagtgtggt

SEQ ID NO: 7778 - DNA, 24 bp, Artificial Sequence
  Synthetic oligonucleotide
agcagggtccacagtgtgtgagat

SEQ ID NO: 7779 - DNA, 23 bp, Artificial Sequence
  Synthetic oligonucleotide
agcaccggccggccgagggaggg

SEQ ID NO: 7780 - DNA, 23 bp, Artificial Sequence
  Synthetic oligonucleotide
agcagagtgccagggagtgagat

SEQ ID NO: 7781 - DNA, 24 bp, Artificial Sequence
  Synthetic oligonucleotide
agcaaggtctgcattgagagaggc

SEQ ID NO: 7782 - DNA, 23 bp, Artificial Sequence
  Synthetic oligonucleotide
agcatggtccagcagagtgagcc

SEQ ID NO: 7783 - DNA, 24 bp, Artificial Sequence
  Synthetic oligonucleotide
atcagtgtcatcctggagtaaggt

SEQ ID NO: 7784 - DNA, 23 bp, Artificial Sequence
  Synthetic oligonucleotide
agcatggtcgtggaaagtgagta

SEQ ID NO: 7785 - DNA, 23 bp, Artificial Sequence
  Synthetic oligonucleotide
agcaatgtctgtgggagggaggc

SEQ ID NO: 7786 - DNA, 24 bp, Artificial Sequence
  Synthetic oligonucleotide
agcattgtctgcagtgagtgtggg

SEQ ID NO: 7787 - DNA, 24 bp, Artificial Sequence
  Synthetic oligonucleotide
agcattgtctccctccagtgaggg

SEQ ID NO: 7788 - DNA, 24 bp, Artificial Sequence
  Synthetic oligonucleotide
agcaaggtcagtgtctagtgaggg

SEQ ID NO: 7789 - DNA, 23 bp, Artificial Sequence
  Synthetic oligonucleotide
agcagggtagtggtgagtaaggt

SEQ ID NO: 7790 - DNA, 23 bp, Artificial Sequence
  Synthetic oligonucleotide
agcagcgcaggccggggtgaggg

SEQ ID NO: 7791 - DNA, 23 bp, Artificial Sequence
  Synthetic oligonucleotide
agcagcattgacatgagtgagat

SEQ ID NO: 7792 - DNA, 24 bp, Artificial Sequence
  Synthetic oligonucleotide
agcatggtcaggttccagtgaggg

SEQ ID NO: 7793 - DNA, 23 bp, Artificial Sequence
  Synthetic oligonucleotide
agctgcatcaccttgagtgagtc

SEQ ID NO: 7794 - DNA, 24 bp, Artificial Sequence
  Synthetic oligonucleotide
agaaacgtccaggtagagtgaaaa

SEQ ID NO: 7795 - DNA, 23 bp, Artificial Sequence
  Synthetic oligonucleotide
tgcagtgtcccatggagggaggt

SEQ ID NO: 7796 - DNA, 24 bp, Artificial Sequence
  Synthetic oligonucleotide
aacaacgtccagcaggagtgtgaa

SEQ ID NO: 7797 - DNA, 23 bp, Artificial Sequence
  Synthetic oligonucleotide
agcaaggtcttaaagagcgagta

SEQ ID NO: 7798 - DNA, 23 bp, Artificial Sequence
  Synthetic oligonucleotide
agcagtgtggggcagtgtgaggc

SEQ ID NO: 7799 - DNA, 23 bp, Artificial Sequence
  Synthetic oligonucleotide
agtagtgtcctgtggagggaggc

SEQ ID NO: 7800 - DNA, 24 bp, Artificial Sequence
  Synthetic oligonucleotide
agcagggttggtttctagtgaggc

SEQ ID NO: 7801 - DNA, 24 bp, Artificial Sequence
  Synthetic oligonucleotide
agcatggtcaggttccagtgaggg

SEQ ID NO: 7802 - DNA, 23 bp, Artificial Sequence
  Synthetic oligonucleotide
agcagcattgacatgagtgagat

SEQ ID NO: 7803 - DNA, 24 bp, Artificial Sequence
  Synthetic oligonucleotide
agcaccgtattctgctagtgaggg

SEQ ID NO: 7804 - DNA, 24 bp, Artificial Sequence
  Synthetic oligonucleotide
agctgtgtctggtgtgagtgagag

SEQ ID NO: 7805 - DNA, 23 bp, Artificial Sequence
  Synthetic oligonucleotide
agccgggtccccacgagtgagtg

SEQ ID NO: 7806 - DNA, 24 bp, Artificial Sequence
  Synthetic oligonucleotide
aacagggtcagagaagagtgagac

SEQ ID NO: 7807 - DNA, 23 bp, Artificial Sequence
  Synthetic oligonucleotide
agcactgtcttggaaagtgaggg

SEQ ID NO: 7808 - DNA, 24 bp, Artificial Sequence
  Synthetic oligonucleotide
agcaacgtggcagaggagggaggt

SEQ ID NO: 7809 - DNA, 24 bp, Artificial Sequence
  Synthetic oligonucleotide
agcagggtgggaactgagggaggt

SEQ ID NO: 7810 - DNA, 23 bp, Artificial Sequence
  Synthetic oligonucleotide
agcacagtcttggggagagaggc

SEQ ID NO: 7811 - DNA, 23 bp, Artificial Sequence
  Synthetic oligonucleotide
agcattgtcacacagagtgaata

SEQ ID NO: 7812 - DNA, 24 bp, Artificial Sequence
  Synthetic oligonucleotide
atcagagtcagcttagagtgagag

SEQ ID NO: 7813 - DNA, 23 bp, Artificial Sequence
  Synthetic oligonucleotide
agcaacctccaggtgagggaggc

SEQ ID NO: 7814 - DNA, 24 bp, Artificial Sequence
  Synthetic oligonucleotide
agcggagtcgctggggagagaggg

SEQ ID NO: 7815 - DNA, 24 bp, Artificial Sequence
  Synthetic oligonucleotide
agcatggtccatttctagtgaggc

SEQ ID NO: 7816 - DNA, 24 bp, Artificial Sequence
  Synthetic oligonucleotide
tgcagtgtccacagcaagtgaggt

SEQ ID NO: 7817 - DNA, 24 bp, Artificial Sequence
  Synthetic oligonucleotide
ggcaccgtcctcctggagggaggc

SEQ ID NO: 7818 - DNA, 24 bp, Artificial Sequence
  Synthetic oligonucleotide
agcaaagtctctaaagagtgtggt

SEQ ID NO: 7819 - DNA, 23 bp, Artificial Sequence
  Synthetic oligonucleotide
agcagcattgacatgagtgagat

SEQ ID NO: 7820 - DNA, 24 bp, Artificial Sequence
  Synthetic oligonucleotide
agcagcattgcacgggggtgaggt

SEQ ID NO: 7821 - DNA, 23 bp, Artificial Sequence
  Synthetic oligonucleotide
agcagtgacagcgggagtgagcc

SEQ ID NO: 7822 - DNA, 24 bp, Artificial Sequence
  Synthetic oligonucleotide
agcagtgaccaatctgagtgagcc

SEQ ID NO: 7823 - DNA, 24 bp, Artificial Sequence
  Synthetic oligonucleotide
agcaatgtcaacagagggtgaggg

SEQ ID NO: 7824 - DNA, 24 bp, Artificial Sequence
  Synthetic oligonucleotide
agcaacatctactaagagtgagcc

SEQ ID NO: 7825 - DNA, 23 bp, Artificial Sequence
  Synthetic oligonucleotide
tgcagggtcagggtgtgtgaggc

SEQ ID NO: 7826 - DNA, 23 bp, Artificial Sequence
  Synthetic oligonucleotide
agcaacggcgactggagtgacca

SEQ ID NO: 7827 - DNA, 24 bp, Artificial Sequence
  Synthetic oligonucleotide
agcatggtccagttccagtgaggg

SEQ ID NO: 7828 - DNA, 24 bp, Artificial Sequence
  Synthetic oligonucleotide
ggcagtgtcctcccacagtgaggc

SEQ ID NO: 7829 - DNA, 24 bp, Artificial Sequence
  Synthetic oligonucleotide
agcaccggccctgggcagtgaggg

SEQ ID NO: 7830 - DNA, 24 bp, Artificial Sequence
  Synthetic oligonucleotide
aacagtgtctataaatagtgaggg

SEQ ID NO: 7831 - DNA, 23 bp, Artificial Sequence
  Synthetic oligonucleotide
agcaaagtcagagggagtgatgt

SEQ ID NO: 7832 - DNA, 23 bp, Artificial Sequence
  Synthetic oligonucleotide
agcaatgtctgcatgagggaggt

SEQ ID NO: 7833 - DNA, 23 bp, Artificial Sequence
  Synthetic oligonucleotide
agcagtctccaggcgagagaggg

SEQ ID NO: 7834 - DNA, 24 bp, Artificial Sequence
  Synthetic oligonucleotide
agcaaagtccttggtaagtgaggg

SEQ ID NO: 7835 - DNA, 23 bp, Artificial Sequence
  Synthetic oligonucleotide
agcagcagcttagagagtgagcc

SEQ ID NO: 7836 - DNA, 23 bp, Artificial Sequence
  Synthetic oligonucleotide
aacatcgtcagtgggagtgtgaa

SEQ ID NO: 7837 - DNA, 24 bp, Artificial Sequence
  Synthetic oligonucleotide
agcaacatccttggggagtgaagt

SEQ ID NO: 7838 - DNA, 23 bp, Artificial Sequence
  Synthetic oligonucleotide
agccccgtcaagcagagggaggc

SEQ ID NO: 7839 - DNA, 23 bp, Artificial Sequence
  Synthetic oligonucleotide
agcagcggttctcagagtgtggc

SEQ ID NO: 7840 - DNA, 24 bp, Artificial Sequence
  Synthetic oligonucleotide
agcaaggtctgagaagagtggtga

SEQ ID NO: 7841 - DNA, 24 bp, Artificial Sequence
  Synthetic oligonucleotide
aacagagtcagagaggtgtgaggc

SEQ ID NO: 7842 - DNA, 24 bp, Artificial Sequence
  Synthetic oligonucleotide
ggcagcgtgtgacagaagtgaggg

SEQ ID NO: 7843 - DNA, 23 bp, Artificial Sequence
  Synthetic oligonucleotide
agcatagtctcccagagtgagtg

SEQ ID NO: 7844 - DNA, 23 bp, Artificial Sequence
  Synthetic oligonucleotide
agccgtgtccccttaagtgaggg

SEQ ID NO: 7845 - DNA, 23 bp, Artificial Sequence
  Synthetic oligonucleotide
agcatggtcaggttcagtgaggg

SEQ ID NO: 7846 - DNA, 23 bp, Artificial Sequence
  Synthetic oligonucleotide
agtagtgtctggtggagtgagtt

SEQ ID NO: 7847 - DNA, 23 bp, Artificial Sequence
  Synthetic oligonucleotide
agcagcattgacatgagtgagat

SEQ ID NO: 7848 - DNA, 24 bp, Artificial Sequence
  Synthetic oligonucleotide
agcagcatttcaagagagtgagag

SEQ ID NO: 7849 - DNA, 24 bp, Artificial Sequence
  Synthetic oligonucleotide
cgcagtgtctggtcacagtgaggc

SEQ ID NO: 7850 - DNA, 23 bp, Artificial Sequence
  Synthetic oligonucleotide
agcagggtggggaagagggaggt

SEQ ID NO: 7851 - DNA, 24 bp, Artificial Sequence
  Synthetic oligonucleotide
agcagggtaatgtgagagtgagtg

SEQ ID NO: 7852 - DNA, 23 bp, Artificial Sequence
  Synthetic oligonucleotide
agcatagtcacttagagtgtggg

SEQ ID NO: 7853 - DNA, 24 bp, Artificial Sequence
  Synthetic oligonucleotide
agcatggtcaggttccagtgaggg

SEQ ID NO: 7854 - DNA, 24 bp, Artificial Sequence
  Synthetic oligonucleotide
tccagcgtcgtgacagagtgagac

SEQ ID NO: 7855 - DNA, 24 bp, Artificial Sequence
  Synthetic oligonucleotide
agcactgtcctgtcagagtgtggc

SEQ ID NO: 7856 - DNA, 23 bp, Artificial Sequence
  Synthetic oligonucleotide
agcatagtccagttcagtgaggc

SEQ ID NO: 7857 - DNA, 24 bp, Artificial Sequence
  Synthetic oligonucleotide
agcagtgtgcaccacgagagaggc

SEQ ID NO: 7858 - DNA, 24 bp, Artificial Sequence
  Synthetic oligonucleotide
agcaacggcaggagagagagggga

SEQ ID NO: 7859 - DNA, 23 bp, Artificial Sequence
  Synthetic oligonucleotide
agccgggtcaccgagagtgagtg

SEQ ID NO: 7860 - DNA, 24 bp, Artificial Sequence
  Synthetic oligonucleotide
agcaatgtcaattttcagtgagca

SEQ ID NO: 7861 - DNA, 23 bp, Artificial Sequence
  Synthetic oligonucleotide
agcaacgtgtggagcagtgaggg

SEQ ID NO: 7862 - DNA, 24 bp, Artificial Sequence
  Synthetic oligonucleotide
agcacggtcagtcttcagtgaggg

SEQ ID NO: 7863 - DNA, 24 bp, Artificial Sequence
  Synthetic oligonucleotide
agcatggtcatgttatagtgagta

SEQ ID NO: 7864 - DNA, 23 bp, Artificial Sequence
  Synthetic oligonucleotide
agcagggtagggaggagtgagtg

SEQ ID NO: 7865 - DNA, 24 bp, Artificial Sequence
  Synthetic oligonucleotide
agcggtgtctgaaaaaagtgaggg

SEQ ID NO: 7866 - DNA, 24 bp, Artificial Sequence
  Synthetic oligonucleotide
agcaaggtccatccagagagaggc

SEQ ID NO: 7867 - DNA, 24 bp, Artificial Sequence
  Synthetic oligonucleotide
agcaccttctagggagtgtgaggc

SEQ ID NO: 7868 - DNA, 24 bp, Artificial Sequence
  Synthetic oligonucleotide
agcaaagtctcacaggagggaggc

SEQ ID NO: 7869 - DNA, 23 bp, Artificial Sequence
  Synthetic oligonucleotide
agcaaggtctgggagagtgatgt

SEQ ID NO: 7870 - DNA, 24 bp, Artificial Sequence
  Synthetic oligonucleotide
agcagcagctgccgggagcgaggc

SEQ ID NO: 7871 - DNA, 23 bp, Artificial Sequence
  Synthetic oligonucleotide
agcaacctcctggggagtgtggg

SEQ ID NO: 7872 - DNA, 24 bp, Artificial Sequence
  Synthetic oligonucleotide
tgcagcgactgaagtgagtgagtg

SEQ ID NO: 7873 - DNA, 23 bp, Artificial Sequence
  Synthetic oligonucleotide
ggcagcttcccagtgagtaaggt

SEQ ID NO: 7874 - DNA, 24 bp, Artificial Sequence
  Synthetic oligonucleotide
aacagtgtcagtgattagtgaggg

SEQ ID NO: 7875 - DNA, 23 bp, Artificial Sequence
  Synthetic oligonucleotide
agcttcgtccagagcagtgaggg

SEQ ID NO: 7876 - DNA, 23 bp, Artificial Sequence
  Synthetic oligonucleotide
agcagcattgacatgagtgagat

SEQ ID NO: 7877 - DNA, 24 bp, Artificial Sequence
  Synthetic oligonucleotide
agcaacgtgatgaaagagtgagat

SEQ ID NO: 7878 - DNA, 24 bp, Artificial Sequence
  Synthetic oligonucleotide
agcaatgtcagtctcaagtgtgga

SEQ ID NO: 7879 - DNA, 23 bp, Artificial Sequence
  Synthetic oligonucleotide
tgcagtgtccctgggagggaggt

SEQ ID NO: 7880 - DNA, 24 bp, Artificial Sequence
  Synthetic oligonucleotide
agcaacggccagtcccagggagga

SEQ ID NO: 7881 - DNA, 23 bp, Artificial Sequence
  Synthetic oligonucleotide
agcatcggctcctcaagtgaggc

SEQ ID NO: 7882 - DNA, 23 bp, Artificial Sequence
  Synthetic oligonucleotide
agcatcggctcctcaagtgaggc

SEQ ID NO: 7883 - DNA, 23 bp, Artificial Sequence
  Synthetic oligonucleotide
agcatcggctcctcaagtgaggc

SEQ ID NO: 7884 - DNA, 23 bp, Artificial Sequence
  Synthetic oligonucleotide
agcaaggtcagagagtgtgaggc

SEQ ID NO: 7885 - DNA, 23 bp, Artificial Sequence
  Synthetic oligonucleotide
agcggagtccagagaagtgaggg

SEQ ID NO: 7886 - DNA, 23 bp, Artificial Sequence
  Synthetic oligonucleotide
agcaccatcagcaccagtgaggt

SEQ ID NO: 7887 - DNA, 23 bp, Artificial Sequence
  Synthetic oligonucleotide
agctgcttcccctagagtgagag

SEQ ID NO: 7888 - DNA, 23 bp, Artificial Sequence
  Synthetic oligonucleotide
agcaacatcactttgagtaaggc

SEQ ID NO: 7889 - DNA, 23 bp, Artificial Sequence
  Synthetic oligonucleotide
aacagtgtcaaatcaagtgaggt

SEQ ID NO: 7890 - DNA, 24 bp, Artificial Sequence
  Synthetic oligonucleotide
agcatcgtacctcaagagacagga

SEQ ID NO: 7891 - DNA, 24 bp, Artificial Sequence
  Synthetic oligonucleotide
agcatggtcggtttccagtgaggg

SEQ ID NO: 7892 - DNA, 24 bp, Artificial Sequence
  Synthetic oligonucleotide
aacagcttcccagcttagtgaggc

SEQ ID NO: 7893 - DNA, 24 bp, Artificial Sequence
  Synthetic oligonucleotide
agcaacttccctggagggtgaggg

SEQ ID NO: 7894 - DNA, 23 bp, Artificial Sequence
  Synthetic oligonucleotide
agcagcattgacatgagtgagat

SEQ ID NO: 7895 - DNA, 24 bp, Artificial Sequence
  Synthetic oligonucleotide
agcagggtggggtgtgagggaggc

SEQ ID NO: 7896 - DNA, 23 bp, Artificial Sequence
  Synthetic oligonucleotide
agcattgtctgaaggagagggga

SEQ ID NO: 7897 - DNA, 23 bp, Artificial Sequence
  Synthetic oligonucleotide
ggcagcgtgtgtgagagtgagct

SEQ ID NO: 7898 - DNA, 23 bp, Artificial Sequence
  Synthetic oligonucleotide
agctgtgtcccccagagtgagag

SEQ ID NO: 7899 - DNA, 23 bp, Artificial Sequence
  Synthetic oligonucleotide
agcagcattcatgtgagtgagat

SEQ ID NO: 7900 - DNA, 23 bp, Artificial Sequence
  Synthetic oligonucleotide
agcagtgtttctctgagtgtggc

SEQ ID NO: 7901 - DNA, 23 bp, Artificial Sequence
  Synthetic oligonucleotide
agcacagtcacccatagtgaggc

SEQ ID NO: 7902 - DNA, 23 bp, Artificial Sequence
  Synthetic oligonucleotide
ggcagcttcagggcaaatgagga

SEQ ID NO: 7903 - DNA, 24 bp, Artificial Sequence
  Synthetic oligonucleotide
agcattgtcataatagagagaggt

SEQ ID NO: 7904 - DNA, 23 bp, Artificial Sequence
  Synthetic oligonucleotide
agcatggtcatggaaagtgagta

SEQ ID NO: 7905 - DNA, 23 bp, Artificial Sequence
  Synthetic oligonucleotide
agcagggtggtaaagagggaggt

SEQ ID NO: 7906 - DNA, 23 bp, Artificial Sequence
  Synthetic oligonucleotide
agcaacttctccactagtgaggg

SEQ ID NO: 7907 - DNA, 23 bp, Artificial Sequence
  Synthetic oligonucleotide
agcagcagccggtggtgtgaggc

SEQ ID NO: 7908 - DNA, 23 bp, Artificial Sequence
  Synthetic oligonucleotide
tgcagggtctcttagagtgagtt

SEQ ID NO: 7909 - DNA, 23 bp, Artificial Sequence
  Synthetic oligonucleotide
tgcagcgttgggctcagtgaggg

SEQ ID NO: 7910 - DNA, 23 bp, Artificial Sequence
  Synthetic oligonucleotide
agcagcatataatagagtgagtc

SEQ ID NO: 7911 - DNA, 23 bp, Artificial Sequence
  Synthetic oligonucleotide
agcagtgtgctaaggagagaggc

SEQ ID NO: 7912 - DNA, 24 bp, Artificial Sequence
  Synthetic oligonucleotide
aacagcatctcagctgggtgaggc

SEQ ID NO: 7913 - DNA, 24 bp, Artificial Sequence
  Synthetic oligonucleotide
agcagtgtgccttgggtgtgaggg

SEQ ID NO: 7914 - DNA, 23 bp, Artificial Sequence
  Synthetic oligonucleotide
aacagagtcgttcagtgtgaggc

SEQ ID NO: 7915 - DNA, 23 bp, Artificial Sequence
  Synthetic oligonucleotide
agcaacgttagcaggagtgtggt

SEQ ID NO: 7916 - DNA, 24 bp, Artificial Sequence
  Synthetic oligonucleotide
agcaaagtctgtaaagagtgtgta

SEQ ID NO: 7917 - DNA, 23 bp, Artificial Sequence
  Synthetic oligonucleotide
tgcatcgtcctatggagggaggt

SEQ ID NO: 7918 - DNA, 24 bp, Artificial Sequence
  Synthetic oligonucleotide
agcaaggtcttgttggagggaggg

SEQ ID NO: 7919 - DNA, 23 bp, Artificial Sequence
  Synthetic oligonucleotide
ggcaccgtcatcctgagtggggc

SEQ ID NO: 7920 - DNA, 24 bp, Artificial Sequence
  Synthetic oligonucleotide
agcagagtaagggaggagtgagag

SEQ ID NO: 7921 - DNA, 23 bp, Artificial Sequence
  Synthetic oligonucleotide
agcaaagtcacagggagtgagcg

SEQ ID NO: 7922 - DNA, 24 bp, Artificial Sequence
  Synthetic oligonucleotide
agaagtgtcactgtccagtgaggc

SEQ ID NO: 7923 - DNA, 23 bp, Artificial Sequence
  Synthetic oligonucleotide
agcagcattgacatgagtgagat

SEQ ID NO: 7924 - DNA, 23 bp, Artificial Sequence
  Synthetic oligonucleotide
agcaaagtcagccagagggagaa

SEQ ID NO: 7925 - DNA, 24 bp, Artificial Sequence
  Synthetic oligonucleotide
agcaaagtctggagtgagtgtgta

SEQ ID NO: 7926 - DNA, 23 bp, Artificial Sequence
  Synthetic oligonucleotide
ggcagtgtccggctgagggaggg

SEQ ID NO: 7927 - DNA, 23 bp, Artificial Sequence
  Synthetic oligonucleotide
agcagcaacagtgtgagtgagtt

SEQ ID NO: 7928 - DNA, 23 bp, Artificial Sequence
  Synthetic oligonucleotide
agcattgtctagcagggtgagaa

SEQ ID NO: 7929 - DNA, 24 bp, Artificial Sequence
  Synthetic oligonucleotide
agcaaggtcactgaggagggaggc

SEQ ID NO: 7930 - DNA, 24 bp, Artificial Sequence
  Synthetic oligonucleotide
agcatcggcagcttggagagaggt

SEQ ID NO: 7931 - DNA, 24 bp, Artificial Sequence
  Synthetic oligonucleotide
agcagggtggtaggggagggaggt

SEQ ID NO: 7932 - DNA, 23 bp, Artificial Sequence
  Synthetic oligonucleotide
agcagcgcttctcaaagtgaggc

SEQ ID NO: 7933 - DNA, 24 bp, Artificial Sequence
  Synthetic oligonucleotide
agcagggtggtgtgagagtgagtg

SEQ ID NO: 7934 - DNA, 24 bp, Artificial Sequence
  Synthetic oligonucleotide
tgcagcgtggccacagagtgagac

SEQ ID NO: 7935 - DNA, 24 bp, Artificial Sequence
  Synthetic oligonucleotide
tgcagtgtcatttgagagtaaggt

SEQ ID NO: 7936 - DNA, 24 bp, Artificial Sequence
  Synthetic oligonucleotide
agcagggtgagcactaagtgaggc

SEQ ID NO: 7937 - DNA, 24 bp, Artificial Sequence
  Synthetic oligonucleotide
aacagggtcagtggggagagaggc

SEQ ID NO: 7938 - DNA, 23 bp, Artificial Sequence
  Synthetic oligonucleotide
aacagcggcctattgtgtgaggg

SEQ ID NO: 7939 - DNA, 23 bp, Artificial Sequence
  Synthetic oligonucleotide
agcaacgttcagctcagtgaggt

SEQ ID NO: 7940 - DNA, 24 bp, Artificial Sequence
  Synthetic oligonucleotide
agcagtgttgccccagggtgaggt

SEQ ID NO: 7941 - DNA, 24 bp, Artificial Sequence
  Synthetic oligonucleotide
agcaccgtgtggggagagggaggt

SEQ ID NO: 7942 - DNA, 23 bp, Artificial Sequence
  Synthetic oligonucleotide
agcaacgttctgtggaatgagca

SEQ ID NO: 7943 - DNA, 23 bp, Artificial Sequence
  Synthetic oligonucleotide
agccacgtcgaatggattgaggg

SEQ ID NO: 7944 - DNA, 24 bp, Artificial Sequence
  Synthetic oligonucleotide
agcagggtggagcgcgagggaggc

SEQ ID NO: 7945 - DNA, 23 bp, Artificial Sequence
  Synthetic oligonucleotide
tgcagcggcctcagaagtgaggg

SEQ ID NO: 7946 - DNA, 24 bp, Artificial Sequence
  Synthetic oligonucleotide
agcattgtctcccttgagtatgga

SEQ ID NO: 7947 - DNA, 23 bp, Artificial Sequence
  Synthetic oligonucleotide
ggcaccgtcctttgcagtgaggt

SEQ ID NO: 7948 - DNA, 24 bp, Artificial Sequence
  Synthetic oligonucleotide
agcatggtcgggcactagtgaggc

SEQ ID NO: 7949 - DNA, 24 bp, Artificial Sequence
  Synthetic oligonucleotide
agcaccttcatgaatgtgtgaggc

SEQ ID NO: 7950 - DNA, 24 bp, Artificial Sequence
  Synthetic oligonucleotide
agtagtgtctaataggtgtgaggt

SEQ ID NO: 7951 - DNA, 24 bp, Artificial Sequence
  Synthetic oligonucleotide
agcaccatcaagatagtgtgaggc

SEQ ID NO: 7952 - DNA, 23 bp, Artificial Sequence
  Synthetic oligonucleotide
agccacgtcacctgaggtgagga

SEQ ID NO: 7953 - DNA, 24 bp, Artificial Sequence
  Synthetic oligonucleotide
agcaacatctgtgtagagcgaggt

SEQ ID NO: 7954 - DNA, 23 bp, Artificial Sequence
  Synthetic oligonucleotide
agccgagtccttgtgggtgaggc

SEQ ID NO: 7955 - DNA, 24 bp, Artificial Sequence
  Synthetic oligonucleotide
accagtgtcctgcagtagtgaggc

SEQ ID NO: 7956 - DNA, 23 bp, Artificial Sequence
  Synthetic oligonucleotide
agcaacgacgggctgcgtgtgga

SEQ ID NO: 7957 - DNA, 23 bp, Artificial Sequence
  Synthetic oligonucleotide
agcagcattgacctgagtgagat

SEQ ID NO: 7958 - DNA, 23 bp, Artificial Sequence
  Synthetic oligonucleotide
agcagcattgacctgagtgagat

SEQ ID NO: 7959 - DNA, 23 bp, Artificial Sequence
  Synthetic oligonucleotide
cgcagtgtcttccccagtgaggc

SEQ ID NO: 7960 - DNA, 23 bp, Artificial Sequence
  Synthetic oligonucleotide
tgcatcgtcagagagtgtgaggg

SEQ ID NO: 7961 - DNA, 24 bp, Artificial Sequence
  Synthetic oligonucleotide
agctgagtccccggcaagtgaggc

SEQ ID NO: 7962 - DNA, 23 bp, Artificial Sequence
  Synthetic oligonucleotide
agcaacgtgtgccagtgtgaggg

SEQ ID NO: 7963 - DNA, 24 bp, Artificial Sequence
  Synthetic oligonucleotide
agcagtggctgggcatagtgaggc

SEQ ID NO: 7964 - DNA, 23 bp, Artificial Sequence
  Synthetic oligonucleotide
agcagcattgacatgagtgagat

SEQ ID NO: 7965 - DNA, 24 bp, Artificial Sequence
  Synthetic oligonucleotide
agcaccatctaggcagagggaggc

SEQ ID NO: 7966 - DNA, 24 bp, Artificial Sequence
  Synthetic oligonucleotide
agcacagtcatggtggagtaaggg

SEQ ID NO: 7967 - DNA, 24 bp, Artificial Sequence
  Synthetic oligonucleotide
agcatggtcaggttccagtgaggg

SEQ ID NO: 7968 - DNA, 24 bp, Artificial Sequence
  Synthetic oligonucleotide
agcatggtcaggttccagtgaggg

SEQ ID NO: 7969 - DNA, 24 bp, Artificial Sequence
  Synthetic oligonucleotide
agtaacgtcatttcagagtgcaga

SEQ ID NO: 7970 - DNA, 24 bp, Artificial Sequence
  Synthetic oligonucleotide
agcaacttctaggatgagtgtgaa

SEQ ID NO: 7971 - DNA, 23 bp, Artificial Sequence
  Synthetic oligonucleotide
agcagcattgacatgagtgagat

SEQ ID NO: 7972 - DNA, 24 bp, Artificial Sequence
  Synthetic oligonucleotide
agcaatgtctgctgtgggtgaggg

SEQ ID NO: 7973 - DNA, 24 bp, Artificial Sequence
  Synthetic oligonucleotide
agcaatgtctgccatgagtgtgaa

SEQ ID NO: 7974 - DNA, 24 bp, Artificial Sequence
  Synthetic oligonucleotide
agcagattcggaattgagtgagtg

SEQ ID NO: 7975 - DNA, 23 bp, Artificial Sequence
  Synthetic oligonucleotide
cacagcgtcggagggagggaggg

SEQ ID NO: 7976 - DNA, 23 bp, Artificial Sequence
  Synthetic oligonucleotide
agcagcgatctaatgagggagaa

SEQ ID NO: 7977 - DNA, 24 bp, Artificial Sequence
  Synthetic oligonucleotide
agcaccgtgagacttgagtgagcc

SEQ ID NO: 7978 - DNA, 23 bp, Artificial Sequence
  Synthetic oligonucleotide
atcagtgtcctggggagtgtggt

SEQ ID NO: 7979 - DNA, 23 bp, Artificial Sequence
  Synthetic oligonucleotide
agcaacctcacggggagggaggc

SEQ ID NO: 7980 - DNA, 24 bp, Artificial Sequence
  Synthetic oligonucleotide
agcaacttcagaagtgagttaggg

SEQ ID NO: 7981 - DNA, 23 bp, Artificial Sequence
  Synthetic oligonucleotide
agcaacttccactagagagaggc

SEQ ID NO: 7982 - DNA, 24 bp, Artificial Sequence
  Synthetic oligonucleotide
agcaacgtggcagatgagagaggt

SEQ ID NO: 7983 - DNA, 24 bp, Artificial Sequence
  Synthetic oligonucleotide
aacagcatcaaatgcgggtgaggc

SEQ ID NO: 7984 - DNA, 23 bp, Artificial Sequence
  Synthetic oligonucleotide
acaagcgtctgtaagagtgagtc

SEQ ID NO: 7985 - DNA, 23 bp, Artificial Sequence
  Synthetic oligonucleotide
tccagcgtcacctaaagtgaggg

SEQ ID NO: 7986 - DNA, 23 bp, Artificial Sequence
  Synthetic oligonucleotide
agcaaggtcaggaagagagaggc

SEQ ID NO: 7987 - DNA, 23 bp, Artificial Sequence
  Synthetic oligonucleotide
agtagcgttttgtccagtgaggt

SEQ ID NO: 7988 - DNA, 24 bp, Artificial Sequence
  Synthetic oligonucleotide
agcagtgtttgctaacagtgaggc

SEQ ID NO: 7989 - DNA, 24 bp, Artificial Sequence
  Synthetic oligonucleotide
agcatggtcaggttccagtgaggg

SEQ ID NO: 7990 - DNA, 23 bp, Artificial Sequence
  Synthetic oligonucleotide
agcagcggaggtcagagtgagtt

SEQ ID NO: 7991 - DNA, 23 bp, Artificial Sequence
  Synthetic oligonucleotide
agcaccgactccatcagtgaggt

SEQ ID NO: 7992 - DNA, 23 bp, Artificial Sequence
  Synthetic oligonucleotide
agcagtgacatgaggagtgagcc

SEQ ID NO: 7993 - DNA, 24 bp, Artificial Sequence
  Synthetic oligonucleotide
agcagggtttctgcagtgtgaggt

SEQ ID NO: 7994 - DNA, 23 bp, Artificial Sequence
  Synthetic oligonucleotide
agcagcatggttaggagtgagat

SEQ ID NO: 7995 - DNA, 23 bp, Artificial Sequence
  Synthetic oligonucleotide
atcagagtcaaagggagggaggc

SEQ ID NO: 7996 - DNA, 24 bp, Artificial Sequence
  Synthetic oligonucleotide
agcagggttggaagaaagtgaggg

SEQ ID NO: 7997 - DNA, 23 bp, Artificial Sequence
  Synthetic oligonucleotide
agcagggtgggcaagagggaggc

SEQ ID NO: 7998 - DNA, 24 bp, Artificial Sequence
  Synthetic oligonucleotide
ggcagtgtctcaaacgagggaggg

SEQ ID NO: 7999 - DNA, 24 bp, Artificial Sequence
  Synthetic oligonucleotide
ggcatcgtcactcttgagtgagag

SEQ ID NO: 8000 - DNA, 23 bp, Artificial Sequence
  Synthetic oligonucleotide
agcaccgtgacttcgagggaggt

SEQ ID NO: 8001 - DNA, 23 bp, Artificial Sequence
  Synthetic oligonucleotide
agcagagtttaaaatagtgaggg

SEQ ID NO: 8002 - DNA, 23 bp, Artificial Sequence
  Synthetic oligonucleotide
gacagcctcattatgagtgaggc

SEQ ID NO: 8003 - DNA, 24 bp, Artificial Sequence
  Synthetic oligonucleotide
aggggggtcttgggagagtgaggt

SEQ ID NO: 8004 - DNA, 23 bp, Artificial Sequence
  Synthetic oligonucleotide
agcctggtccgtgagtgtgagga

SEQ ID NO: 8005 - DNA, 24 bp, Artificial Sequence
  Synthetic oligonucleotide
ggcagcgatgagattgagtgaggg

SEQ ID NO: 8006 - DNA, 23 bp, Artificial Sequence
  Synthetic oligonucleotide
aacaaggtcataaagagggagga

SEQ ID NO: 8007 - DNA, 23 bp, Artificial Sequence
  Synthetic oligonucleotide
agctgagacttagagagtgaggt

SEQ ID NO: 8008 - DNA, 23 bp, Artificial Sequence
  Synthetic oligonucleotide
agctgagacttagagagtgaggt

SEQ ID NO: 8009 - DNA, 24 bp, Artificial Sequence
  Synthetic oligonucleotide
ggcagagtggaggaagagtgaggc

SEQ ID NO: 8010 - DNA, 24 bp, Artificial Sequence
  Synthetic oligonucleotide
agctgggttggagtggagtgaggg

SEQ ID NO: 8011 - DNA, 24 bp, Artificial Sequence
  Synthetic oligonucleotide
agcaaaggctaaagagtgtgagga

SEQ ID NO: 8012 - DNA, 24 bp, Artificial Sequence
  Synthetic oligonucleotide
agtaacggcggggctgagggagga

SEQ ID NO: 8013 - DNA, 23 bp, Artificial Sequence
  Synthetic oligonucleotide
agcattgttctcagaagtgagga

SEQ ID NO: 8014 - DNA, 23 bp, Artificial Sequence
  Synthetic oligonucleotide
cacagcatcagcaggagtgaggg

SEQ ID NO: 8015 - DNA, 23 bp, Artificial Sequence
  Synthetic oligonucleotide
agccacatcagtctgagtaagga

SEQ ID NO: 8016 - DNA, 24 bp, Artificial Sequence
  Synthetic oligonucleotide
agcagcacacaggccgagtgaggt

SEQ ID NO: 8017 - DNA, 23 bp, Artificial Sequence
  Synthetic oligonucleotide
agcattgccttttggagtgaggg

SEQ ID NO: 8018 - DNA, 24 bp, Artificial Sequence
  Synthetic oligonucleotide
agaagtgccatctgggagtgaggg

SEQ ID NO: 8019 - DNA, 23 bp, Artificial Sequence
  Synthetic oligonucleotide
atcagcatacaggggagtgaggc

SEQ ID NO: 8020 - DNA, 24 bp, Artificial Sequence
  Synthetic oligonucleotide
agcaggtacgtgcctgagtgaggc

SEQ ID NO: 8021 - DNA, 23 bp, Artificial Sequence
  Synthetic oligonucleotide
aactacgtccaccagagtgggga

SEQ ID NO: 8022 - DNA, 24 bp, Artificial Sequence
  Synthetic oligonucleotide
agaagtgccatctaggagtgaggg

SEQ ID NO: 8023 - DNA, 23 bp, Artificial Sequence
  Synthetic oligonucleotide
aggagtctcatactgagtgaggt

SEQ ID NO: 8024 - DNA, 23 bp, Artificial Sequence
  Synthetic oligonucleotide
tccagcggccacaggagtgaggt

SEQ ID NO: 8025 - DNA, 23 bp, Artificial Sequence
  Synthetic oligonucleotide
agctcagtctcccagggtgagga

SEQ ID NO: 8026 - DNA, 23 bp, Artificial Sequence
  Synthetic oligonucleotide
agctcagtctctcagggtgagga

SEQ ID NO: 8027 - DNA, 24 bp, Artificial Sequence
  Synthetic oligonucleotide
aacagtatctattctgagtgaggc

SEQ ID NO: 8028 - DNA, 24 bp, Artificial Sequence
  Synthetic oligonucleotide
ggaagtgtcttactggagtgaggt

SEQ ID NO: 8029 - DNA, 23 bp, Artificial Sequence
  Synthetic oligonucleotide
ctcagagtcaaacagagtgaggt

SEQ ID NO: 8030 - DNA, 24 bp, Artificial Sequence
  Synthetic oligonucleotide
aacagtgttttggccgagtgaggg

SEQ ID NO: 8031 - DNA, 23 bp, Artificial Sequence
  Synthetic oligonucleotide
ctcagcttcctgtggagtgaggc

SEQ ID NO: 8032 - DNA, 23 bp, Artificial Sequence
  Synthetic oligonucleotide
agcagctgtagggagagtgaggt

SEQ ID NO: 8033 - DNA, 23 bp, Artificial Sequence
  Synthetic oligonucleotide
agctgtgtgatcctgagtgaggg

SEQ ID NO: 8034 - DNA, 24 bp, Artificial Sequence
  Synthetic oligonucleotide
aggtgtgtctttggagagtgaggc

SEQ ID NO: 8035 - DNA, 24 bp, Artificial Sequence
  Synthetic oligonucleotide
attagagtctgggttgggtgagga

SEQ ID NO: 8036 - DNA, 24 bp, Artificial Sequence
  Synthetic oligonucleotide
agccggctcgcgagtgagtgaggg

SEQ ID NO: 8037 - DNA, 24 bp, Artificial Sequence
  Synthetic oligonucleotide
agcaccagcccgggtgagtgaggt

SEQ ID NO: 8038 - DNA, 23 bp, Artificial Sequence
  Synthetic oligonucleotide
ttcagcgttgtgaagagtgaggc

SEQ ID NO: 8039 - DNA, 23 bp, Artificial Sequence
  Synthetic oligonucleotide
agctccttcgaggagagtgaggc

SEQ ID NO: 8040 - DNA, 24 bp, Artificial Sequence
  Synthetic oligonucleotide
aagagtgtcctggttgagtgaggc

SEQ ID NO: 8041 - DNA, 23 bp, Artificial Sequence
  Synthetic oligonucleotide
tgcagggtagttgggagtgaggt

SEQ ID NO: 8042 - DNA, 24 bp, Artificial Sequence
  Synthetic oligonucleotide
aggatcatccagagtgagtgaggc

SEQ ID NO: 8043 - DNA, 24 bp, Artificial Sequence
  Synthetic oligonucleotide
gtctgcgtccgaagggagtgaggg

SEQ ID NO: 8044 - DNA, 23 bp, Artificial Sequence
  Synthetic oligonucleotide
atgagcgactgatggagtgaggg

SEQ ID NO: 8045 - DNA, 24 bp, Artificial Sequence
  Synthetic oligonucleotide
cccagggtccacagagagtgaggc

SEQ ID NO: 8046 - DNA, 24 bp, Artificial Sequence
  Synthetic oligonucleotide
agtacagtccatttggagggagga

SEQ ID NO: 8047 - DNA, 24 bp, Artificial Sequence
  Synthetic oligonucleotide
agcttcctccatcttgagtgaggc

SEQ ID NO: 8048 - DNA, 23 bp, Artificial Sequence
  Synthetic oligonucleotide
agaagtgcctcctggagtgaggg

SEQ ID NO: 8049 - DNA, 23 bp, Artificial Sequence
  Synthetic oligonucleotide
ggcagagtggatcagagtgaggc

SEQ ID NO: 8050 - DNA, 23 bp, Artificial Sequence
  Synthetic oligonucleotide
agcagttcctaaaagagtgaggg

SEQ ID NO: 8051 - DNA, 23 bp, Artificial Sequence
  Synthetic oligonucleotide
ggcactgtcgctcagagtgaggt

SEQ ID NO: 8052 - DNA, 24 bp, Artificial Sequence
  Synthetic oligonucleotide
agcaggcacagcctggagtgaggc

SEQ ID NO: 8053 - DNA, 23 bp, Artificial Sequence
  Synthetic oligonucleotide
agtggagtcccctagagtgagaa

SEQ ID NO: 8054 - DNA, 23 bp, Artificial Sequence
  Synthetic oligonucleotide
aggacagtcgcagagagtgaggc

SEQ ID NO: 8055 - DNA, 24 bp, Artificial Sequence
  Synthetic oligonucleotide
agctgtgtgctgccagagtgaggc

SEQ ID NO: 8056 - DNA, 24 bp, Artificial Sequence
  Synthetic oligonucleotide
agcaaggtgggtggcgtgtgagga

SEQ ID NO: 8057 - DNA, 24 bp, Artificial Sequence
  Synthetic oligonucleotide
tgctgtgtccccagtgagtgaggg

SEQ ID NO: 8058 - DNA, 23 bp, Artificial Sequence
  Synthetic oligonucleotide
ggcacagtctgacagagagagga

SEQ ID NO: 8059 - DNA, 23 bp, Artificial Sequence
  Synthetic oligonucleotide
agctcagtctcacagggtgagga

SEQ ID NO: 8060 - DNA, 24 bp, Artificial Sequence
  Synthetic oligonucleotide
gtcagtgtcatgcttgagtgaggc

SEQ ID NO: 8061 - DNA, 24 bp, Artificial Sequence
  Synthetic oligonucleotide
ggaagggtcccagtggagtgaggt

SEQ ID NO: 8062 - DNA, 23 bp, Artificial Sequence
  Synthetic oligonucleotide
aggagcaacaaagagagtgaggg

SEQ ID NO: 8063 - DNA, 23 bp, Artificial Sequence
  Synthetic oligonucleotide
agcggtttcagtgagagtgaggc

SEQ ID NO: 8064 - DNA, 23 bp, Artificial Sequence
  Synthetic oligonucleotide
agcagcacggggtgaagtgagga

SEQ ID NO: 8065 - DNA, 24 bp, Artificial Sequence
  Synthetic oligonucleotide
agaagggtggagaaggagtgaggt

SEQ ID NO: 8066 - DNA, 24 bp, Artificial Sequence
  Synthetic oligonucleotide
tgctgtgtccatccagagtgaggg

SEQ ID NO: 8067 - DNA, 23 bp, Artificial Sequence
  Synthetic oligonucleotide
agctcagtcaactggggtgagga

SEQ ID NO: 8068 - DNA, 24 bp, Artificial Sequence
  Synthetic oligonucleotide
agcaaggttaggttctagtgagga

SEQ ID NO: 8069 - DNA, 23 bp, Artificial Sequence
  Synthetic oligonucleotide
agctcagtctctcagggtgagga

SEQ ID NO: 8070 - DNA, 23 bp, Artificial Sequence
  Synthetic oligonucleotide
agcacggtggtcaagagtgaggc

SEQ ID NO: 8071 - DNA, 23 bp, Artificial Sequence
  Synthetic oligonucleotide
agcagggatttgcagagtgaggc

SEQ ID NO: 8072 - DNA, 24 bp, Artificial Sequence
  Synthetic oligonucleotide
atcagctttggggttgagtgaggt

SEQ ID NO: 8073 - DNA, 23 bp, Artificial Sequence
  Synthetic oligonucleotide
agcacagacagcatgagtgaggc

SEQ ID NO: 8074 - DNA, 23 bp, Artificial Sequence
  Synthetic oligonucleotide
cccagcttctcagggagtgaggc

SEQ ID NO: 8075 - DNA, 23 bp, Artificial Sequence
  Synthetic oligonucleotide
cgccccgtctgggaaagtgagga

SEQ ID NO: 8076 - DNA, 23 bp, Artificial Sequence
  Synthetic oligonucleotide
agcagaggttcccagagtgaggc

SEQ ID NO: 8077 - DNA, 24 bp, Artificial Sequence
  Synthetic oligonucleotide
agccacctcccctgcgagtaagga

SEQ ID NO: 8078 - DNA, 24 bp, Artificial Sequence
  Synthetic oligonucleotide
agccctgtctgttaagagtgaggt

SEQ ID NO: 8079 - DNA, 23 bp, Artificial Sequence
  Synthetic oligonucleotide
agcagcagtctctggagtgaggt

SEQ ID NO: 8080 - DNA, 24 bp, Artificial Sequence
  Synthetic oligonucleotide
agccacttctagggagagtgagta

SEQ ID NO: 8081 - DNA, 23 bp, Artificial Sequence
  Synthetic oligonucleotide
aggtgcggcaggtagagtgaggg

SEQ ID NO: 8082 - DNA, 23 bp, Artificial Sequence
  Synthetic oligonucleotide
agctgtgtggttgggagtgaggg

SEQ ID NO: 8083 - DNA, 24 bp, Artificial Sequence
  Synthetic oligonucleotide
aggcgcttcatttatgagtgaggt

SEQ ID NO: 8084 - DNA, 24 bp, Artificial Sequence
  Synthetic oligonucleotide
aggagtctcacgatagagtgaggt

SEQ ID NO: 8085 - DNA, 24 bp, Artificial Sequence
  Synthetic oligonucleotide
atcatcctccgcactgagtgaggg

SEQ ID NO: 8086 - DNA, 24 bp, Artificial Sequence
  Synthetic oligonucleotide
agccgggtaggggatgagtgaggc

SEQ ID NO: 8087 - DNA, 24 bp, Artificial Sequence
  Synthetic oligonucleotide
agcaactgctttgtggagtgaggt

SEQ ID NO: 8088 - DNA, 24 bp, Artificial Sequence
  Synthetic oligonucleotide
ggcagcatttgaagggagtgaggg

SEQ ID NO: 8089 - DNA, 24 bp, Artificial Sequence
  Synthetic oligonucleotide
cacagcatctgaggtgagtgaggg

SEQ ID NO: 8090 - DNA, 23 bp, Artificial Sequence
  Synthetic oligonucleotide
agctgagacttagagagtgaggt

SEQ ID NO: 8091 - DNA, 24 bp, Artificial Sequence
  Synthetic oligonucleotide
acccgtgtcacagttgagtgaggg

SEQ ID NO: 8092 - DNA, 24 bp, Artificial Sequence
  Synthetic oligonucleotide
agccctgtctgctgggagtgaggg

SEQ ID NO: 8093 - DNA, 23 bp, Artificial Sequence
  Synthetic oligonucleotide
ggacgcgtcaggctgagtgaggt

SEQ ID NO: 8094 - DNA, 23 bp, Artificial Sequence
  Synthetic oligonucleotide
aggaacctcgtgcggagtgaggc

SEQ ID NO: 8095 - DNA, 23 bp, Artificial Sequence
  Synthetic oligonucleotide
agctgtgtggccttgagtgaggc

SEQ ID NO: 8096 - DNA, 23 bp, Artificial Sequence
  Synthetic oligonucleotide
cgctgcgaccttcagagtgaggc

SEQ ID NO: 8097 - DNA, 23 bp, Artificial Sequence
  Synthetic oligonucleotide
ggtagagtcagacagagtgaggg

SEQ ID NO: 8098 - DNA, 23 bp, Artificial Sequence
  Synthetic oligonucleotide
agctgagacttagagagtgaggt

SEQ ID NO: 8099 - DNA, 24 bp, Artificial Sequence
  Synthetic oligonucleotide
accaacctcctgtcagagtgaggc

SEQ ID NO: 8100 - DNA, 24 bp, Artificial Sequence
  Synthetic oligonucleotide
agcagtctgctgcaggagtgaggg

SEQ ID NO: 8101 - DNA, 24 bp, Artificial Sequence
  Synthetic oligonucleotide
tgctgtgtcctcacatagtgagga

SEQ ID NO: 8102 - DNA, 24 bp, Artificial Sequence
  Synthetic oligonucleotide
agaaacttcaagaaggagtgaggt

SEQ ID NO: 8103 - DNA, 24 bp, Artificial Sequence
  Synthetic oligonucleotide
aacaatgtcgtcacagagtgagta

SEQ ID NO: 8104 - DNA, 24 bp, Artificial Sequence
  Synthetic oligonucleotide
agaagggtgaataaggagtgaggt

SEQ ID NO: 8105 - DNA, 23 bp, Artificial Sequence
  Synthetic oligonucleotide
tgcagcggaggcaggagtgaggg

SEQ ID NO: 8106 - DNA, 23 bp, Artificial Sequence
  Synthetic oligonucleotide
agctgtgtgacctcgagtgaggc

SEQ ID NO: 8107 - DNA, 23 bp, Artificial Sequence
  Synthetic oligonucleotide
aatagagtcctggggagtgaggc

SEQ ID NO: 8108 - DNA, 23 bp, Artificial Sequence
  Synthetic oligonucleotide
agctgagacttagagagtgaggt

SEQ ID NO: 8109 - DNA, 23 bp, Artificial Sequence
  Synthetic oligonucleotide
agctgagacttagagagtgaggt

SEQ ID NO: 8110 - DNA, 24 bp, Artificial Sequence
  Synthetic oligonucleotide
agtagcatttttagtgagtgaggg

SEQ ID NO: 8111 - DNA, 24 bp, Artificial Sequence
  Synthetic oligonucleotide
accggagtcatccctgagtgaggg

SEQ ID NO: 8112 - DNA, 23 bp, Artificial Sequence
  Synthetic oligonucleotide
agcagtctgaaggggagtgaggg

SEQ ID NO: 8113 - DNA, 24 bp, Artificial Sequence
  Synthetic oligonucleotide
agcagcacacaggccgagtgaggt

SEQ ID NO: 8114 - DNA, 23 bp, Artificial Sequence
  Synthetic oligonucleotide
agcagccatcagaggagtgaggc

SEQ ID NO: 8115 - DNA, 24 bp, Artificial Sequence
  Synthetic oligonucleotide
gccagggtccaaatggagtgaggc

SEQ ID NO: 8116 - DNA, 23 bp, Artificial Sequence
  Synthetic oligonucleotide
agcatcttagtgatgagtgaggt

SEQ ID NO: 8117 - DNA, 23 bp, Artificial Sequence
  Synthetic oligonucleotide
aggagcaacagagagagtgaggg

SEQ ID NO: 8118 - DNA, 24 bp, Artificial Sequence
  Synthetic oligonucleotide
agcaggtttattagggagtgaggg

SEQ ID NO: 8119 - DNA, 23 bp, Artificial Sequence
  Synthetic oligonucleotide
gacagcctctcccagagtgaggc

SEQ ID NO: 8120 - DNA, 23 bp, Artificial Sequence
  Synthetic oligonucleotide
agcagcaatggcaggagtgaggt

SEQ ID NO: 8121 - DNA, 23 bp, Artificial Sequence
  Synthetic oligonucleotide
ggcagcggtagagatagtgagga

SEQ ID NO: 8122 - DNA, 23 bp, Artificial Sequence
  Synthetic oligonucleotide
agtggagtcctggagagtgagta

SEQ ID NO: 8123 - DNA, 23 bp, Artificial Sequence
  Synthetic oligonucleotide
agcctggtctggccgtgtgagga

SEQ ID NO: 8124 - DNA, 24 bp, Artificial Sequence
  Synthetic oligonucleotide
agaaccgaccagccagagtgaggg

SEQ ID NO: 8125 - DNA, 23 bp, Artificial Sequence
  Synthetic oligonucleotide
agcaacatgacccagagtgaggg

SEQ ID NO: 8126 - DNA, 23 bp, Artificial Sequence
  Synthetic oligonucleotide
agctcagtcttgcagggtgagga

SEQ ID NO: 8127 - DNA, 23 bp, Artificial Sequence
  Synthetic oligonucleotide
agctcagtctcacagggtgagga

SEQ ID NO: 8128 - DNA, 24 bp, Artificial Sequence
  Synthetic oligonucleotide
tgcaatgtcaagcttgagtgagaa

SEQ ID NO: 8129 - DNA, 23 bp, Artificial Sequence
  Synthetic oligonucleotide
ggccccgtcacggtgagtgaggg

SEQ ID NO: 8130 - DNA, 23 bp, Artificial Sequence
  Synthetic oligonucleotide
agctcagtctcacagggtgagga

SEQ ID NO: 8131 - DNA, 24 bp, Artificial Sequence
  Synthetic oligonucleotide
agcaatgtagggagggagtgaggg

SEQ ID NO: 8132 - DNA, 24 bp, Artificial Sequence
  Synthetic oligonucleotide
agtaacatcctgtttgtgtgagga

SEQ ID NO: 8133 - DNA, 24 bp, Artificial Sequence
  Synthetic oligonucleotide
atcattgtctccactgagtgagaa

SEQ ID NO: 8134 - DNA, 23 bp, Artificial Sequence
  Synthetic oligonucleotide
agtagagtttaggggagtgaggg

SEQ ID NO: 8135 - DNA, 24 bp, Artificial Sequence
  Synthetic oligonucleotide
agcaggggtcagctggagtgaggg

SEQ ID NO: 8136 - DNA, 24 bp, Artificial Sequence
  Synthetic oligonucleotide
tgctgtgtcttcctggagtgaggc

SEQ ID NO: 8137 - DNA, 24 bp, Artificial Sequence
  Synthetic oligonucleotide
attagagtcagagcagggtgagga

SEQ ID NO: 8138 - DNA, 23 bp, Artificial Sequence
  Synthetic oligonucleotide
agaagggtgagcaagagtgaggt

SEQ ID NO: 8139 - DNA, 24 bp, Artificial Sequence
  Synthetic oligonucleotide
ctcagtgtctctgtgaagtgagga

SEQ ID NO: 8140 - DNA, 24 bp, Artificial Sequence
  Synthetic oligonucleotide
agctgtgttctggatgagtgaggt

SEQ ID NO: 8141 - DNA, 24 bp, Artificial Sequence
  Synthetic oligonucleotide
agtacagtctagccagagggagga

SEQ ID NO: 8142 - DNA, 24 bp, Artificial Sequence
  Synthetic oligonucleotide
agccgctttattcaagagtgaggg

SEQ ID NO: 8143 - DNA, 23 bp, Artificial Sequence
  Synthetic oligonucleotide
accggtgtcgtcgtgagtgaggg

SEQ ID NO: 8144 - DNA, 23 bp, Artificial Sequence
  Synthetic oligonucleotide
agcagtgctgaggcgagtgaggc

SEQ ID NO: 8145 - DNA, 23 bp, Artificial Sequence
  Synthetic oligonucleotide
agctcagtctcacagggtgagga

SEQ ID NO: 8146 - DNA, 24 bp, Artificial Sequence
  Synthetic oligonucleotide
atctgcatctctcttgagtgaggt

SEQ ID NO: 8147 - DNA, 24 bp, Artificial Sequence
  Synthetic oligonucleotide
agcacaatcccccaagagtgaggg

SEQ ID NO: 8148 - DNA, 23 bp, Artificial Sequence
  Synthetic oligonucleotide
agctcagtctcacagggtgagga

SEQ ID NO: 8149 - DNA, 23 bp, Artificial Sequence
  Synthetic oligonucleotide
atcatcatcttggagagtgaggc

SEQ ID NO: 8150 - DNA, 24 bp, Artificial Sequence
  Synthetic oligonucleotide
ggtagagtcactgtagagtgaggg

SEQ ID NO: 8151 - DNA, 24 bp, Artificial Sequence
  Synthetic oligonucleotide
agctgtgtgctgggggagtgaggc

SEQ ID NO: 8152 - DNA, 23 bp, Artificial Sequence
  Synthetic oligonucleotide
atgagtgtcaggtggagtgaggg

SEQ ID NO: 8153 - DNA, 24 bp, Artificial Sequence
  Synthetic oligonucleotide
ggcagagtggtccaggagtgaggc

SEQ ID NO: 8154 - DNA, 24 bp, Artificial Sequence
  Synthetic oligonucleotide
aggagtctccagggggagtgaggc

SEQ ID NO: 8155 - DNA, 23 bp, Artificial Sequence
  Synthetic oligonucleotide
agccaagtcctgaggggtgagga

SEQ ID NO: 8156 - DNA, 23 bp, Artificial Sequence
  Synthetic oligonucleotide
cgctgagtccagaggagtgaggc

SEQ ID NO: 8157 - DNA, 24 bp, Artificial Sequence
  Synthetic oligonucleotide
ggctccgtcttatgtgagtgaggc

SEQ ID NO: 8158 - DNA, 23 bp, Artificial Sequence
  Synthetic oligonucleotide
agcagcagtgaggagagtgaggc

SEQ ID NO: 8159 - DNA, 23 bp, Artificial Sequence
  Synthetic oligonucleotide
agtactgtcaactacagtgagga

SEQ ID NO: 8160 - DNA, 24 bp, Artificial Sequence
  Synthetic oligonucleotide
atgagcggccggtaggagtgaggt

SEQ ID NO: 8161 - DNA, 23 bp, Artificial Sequence
  Synthetic oligonucleotide
tgcaaggtcaggataagtgagga

SEQ ID NO: 8162 - DNA, 23 bp, Artificial Sequence
  Synthetic oligonucleotide
agtacagtcactgttagtgagga

SEQ ID NO: 8163 - DNA, 23 bp, Artificial Sequence
  Synthetic oligonucleotide
atcattgtcaggttgagtgagaa

SEQ ID NO: 8164 - DNA, 24 bp, Artificial Sequence
  Synthetic oligonucleotide
ctcagcggctgctgtgagtgaggg

SEQ ID NO: 8165 - DNA, 24 bp, Artificial Sequence
  Synthetic oligonucleotide
agcagtcccatccaagagtgaggg

SEQ ID NO: 8166 - DNA, 24 bp, Artificial Sequence
  Synthetic oligonucleotide
agcacaggctggacagagtgaggt

SEQ ID NO: 8167 - DNA, 24 bp, Artificial Sequence
  Synthetic oligonucleotide
agcaaccacctcctggagggagga

SEQ ID NO: 8168 - DNA, 23 bp, Artificial Sequence
  Synthetic oligonucleotide
agtaaggtcaaggagagggagga

SEQ ID NO: 8169 - DNA, 23 bp, Artificial Sequence
  Synthetic oligonucleotide
cgccccgtctggagaagtgagga

SEQ ID NO: 8170 - DNA, 23 bp, Artificial Sequence
  Synthetic oligonucleotide
tgcacagtcacatggtgtgagga

SEQ ID NO: 8171 - DNA, 23 bp, Artificial Sequence
  Synthetic oligonucleotide
agcagcaagtggcagagtgaggc

SEQ ID NO: 8172 - DNA, 23 bp, Artificial Sequence
  Synthetic oligonucleotide
agctcagtctcacagggtgagga

SEQ ID NO: 8173 - DNA, 23 bp, Artificial Sequence
  Synthetic oligonucleotide
ggcagggtttctcagagtgaggt

SEQ ID NO: 8174 - DNA, 23 bp, Artificial Sequence
  Synthetic oligonucleotide
aggatggtccttccaagtgagga

SEQ ID NO: 8175 - DNA, 23 bp, Artificial Sequence
  Synthetic oligonucleotide
agcaaccccattttgagtgaggg

SEQ ID NO: 8176 - DNA, 24 bp, Artificial Sequence
  Synthetic oligonucleotide
agaagccacatcagtgagtgaggg

SEQ ID NO: 8177 - DNA, 24 bp, Artificial Sequence
  Synthetic oligonucleotide
accaatgtcacctgtgtgtgagga

SEQ ID NO: 8178 - DNA, 23 bp, Artificial Sequence
  Synthetic oligonucleotide
aggtgcgtggagtggagtgaggg

SEQ ID NO: 8179 - DNA, 23 bp, Artificial Sequence
  Synthetic oligonucleotide
agcagtgaagggaagagtgaggc

SEQ ID NO: 8180 - DNA, 24 bp, Artificial Sequence
  Synthetic oligonucleotide
agctgagtgacagctgagtgaggg

SEQ ID NO: 8181 - DNA, 23 bp, Artificial Sequence
  Synthetic oligonucleotide
agcagtgcgtgcatgagtgaggg

SEQ ID NO: 8182 - DNA, 23 bp, Artificial Sequence
  Synthetic oligonucleotide
ggcggggtctgctcgagtgaggc

SEQ ID NO: 8183 - DNA, 23 bp, Artificial Sequence
  Synthetic oligonucleotide
agaatagtcttagacagtgagga

SEQ ID NO: 8184 - DNA, 23 bp, Artificial Sequence
  Synthetic oligonucleotide
agcagggatttgcagagtgaggc

SEQ ID NO: 8185 - DNA, 23 bp, Artificial Sequence
  Synthetic oligonucleotide
ggaagtgtccaagggagtgaggt

SEQ ID NO: 8186 - DNA, 24 bp, Artificial Sequence
  Synthetic oligonucleotide
atcaatgtcctctgtgagtgaggg

SEQ ID NO: 8187 - DNA, 23 bp, Artificial Sequence
  Synthetic oligonucleotide
cccagcttcctggggagtgaggc

SEQ ID NO: 8188 - DNA, 23 bp, Artificial Sequence
  Synthetic oligonucleotide
aggtgcggcaggtagagtgaggg

SEQ ID NO: 8189 - DNA, 23 bp, Artificial Sequence
  Synthetic oligonucleotide
agctgagacttagagagtgaggt

SEQ ID NO: 8190 - DNA, 23 bp, Artificial Sequence
  Synthetic oligonucleotide
agcaacatggctcagagtgaggg

SEQ ID NO: 8191 - DNA, 24 bp, Artificial Sequence
  Synthetic oligonucleotide
tgcgccgtctactaggagtgaggc

SEQ ID NO: 8192 - DNA, 24 bp, Artificial Sequence
  Synthetic oligonucleotide
agcaaagtttaacaagagtgagaa

SEQ ID NO: 8193 - DNA, 24 bp, Artificial Sequence
  Synthetic oligonucleotide
agcaaagtttaacaagagtgagaa

SEQ ID NO: 8194 - DNA, 24 bp, Artificial Sequence
  Synthetic oligonucleotide
agcaaagtttaacaagagtgagaa

SEQ ID NO: 8195 - DNA, 24 bp, Artificial Sequence
  Synthetic oligonucleotide
agcaaagtttaacaagagtgagaa

SEQ ID NO: 8196 - DNA, 24 bp, Artificial Sequence
  Synthetic oligonucleotide
agcaaagtttaacaagagtgagaa

SEQ ID NO: 8197 - DNA, 23 bp, Artificial Sequence
  Synthetic oligonucleotide
agtatcatccggctgagtgaggt

SEQ ID NO: 8198 - DNA, 23 bp, Artificial Sequence
  Synthetic oligonucleotide
agctgagacttagagagtgaggt

SEQ ID NO: 8199 - DNA, 24 bp, Artificial Sequence
  Synthetic oligonucleotide
aggagcaaccacagggagtgaggg

SEQ ID NO: 8200 - DNA, 23 bp, Artificial Sequence
  Synthetic oligonucleotide
agcagctcgctgaggagtgaggg

SEQ ID NO: 8201 - DNA, 23 bp, Artificial Sequence
  Synthetic oligonucleotide
agctgagacttagagagtgaggt

SEQ ID NO: 8202 - DNA, 24 bp, Artificial Sequence
  Synthetic oligonucleotide
agcaatgtgagttgtgagtgaggg

SEQ ID NO: 8203 - DNA, 24 bp, Artificial Sequence
  Synthetic oligonucleotide
agaagcggtgcgtctgagtgaggt

SEQ ID NO: 8204 - DNA, 24 bp, Artificial Sequence
  Synthetic oligonucleotide
agaagtgccatctgtgagtgaggg

SEQ ID NO: 8205 - DNA, 23 bp, Artificial Sequence
  Synthetic oligonucleotide
ggatgagtctggaggagtgagga

SEQ ID NO: 8206 - DNA, 24 bp, Artificial Sequence
  Synthetic oligonucleotide
acaggtgtccaagatgagtgagga

SEQ ID NO: 8207 - DNA, 24 bp, Artificial Sequence
  Synthetic oligonucleotide
ctgggcgtccctccagagtgagga

SEQ ID NO: 8208 - DNA, 24 bp, Artificial Sequence
  Synthetic oligonucleotide
cccggggtcttcagtgagtgagga

SEQ ID NO: 8209 - DNA, 23 bp, Artificial Sequence
  Synthetic oligonucleotide
tggcacgtctgagggagtgagga

SEQ ID NO: 8210 - DNA, 24 bp, Artificial Sequence
  Synthetic oligonucleotide
agctcagtacaaaaagagtgagga

SEQ ID NO: 8211 - DNA, 23 bp, Artificial Sequence
  Synthetic oligonucleotide
aaaaggttcagagggagtgagga

SEQ ID NO: 8212 - DNA, 24 bp, Artificial Sequence
  Synthetic oligonucleotide
gacatcatcagaactgagtgagga

SEQ ID NO: 8213 - DNA, 24 bp, Artificial Sequence
  Synthetic oligonucleotide
agcactattctattagagtgagga

SEQ ID NO: 8214 - DNA, 23 bp, Artificial Sequence
  Synthetic oligonucleotide
ccctgagtctgagggagtgagga

SEQ ID NO: 8215 - DNA, 23 bp, Artificial Sequence
  Synthetic oligonucleotide
tggggagtcagtgcgagtgagga

SEQ ID NO: 8216 - DNA, 23 bp, Artificial Sequence
  Synthetic oligonucleotide
aacagggcttctgagagtgagga

SEQ ID NO: 8217 - DNA, 23 bp, Artificial Sequence
  Synthetic oligonucleotide
agcaaagctcgagagagtgagga

SEQ ID NO: 8218 - DNA, 23 bp, Artificial Sequence
  Synthetic oligonucleotide
aacattgtttcagtgagtgagga

SEQ ID NO: 8219 - DNA, 24 bp, Artificial Sequence
  Synthetic oligonucleotide
agacacttcatgaatgagtgagga

SEQ ID NO: 8220 - DNA, 24 bp, Artificial Sequence
  Synthetic oligonucleotide
gcccacgtcttcgtggagtgagga

SEQ ID NO: 8221 - DNA, 24 bp, Artificial Sequence
  Synthetic oligonucleotide
aacatggttgtgtgggagtgagga

SEQ ID NO: 8222 - DNA, 24 bp, Artificial Sequence
  Synthetic oligonucleotide
ggtacagtcttcgccgagtgagga

SEQ ID NO: 8223 - DNA, 24 bp, Artificial Sequence
  Synthetic oligonucleotide
ggcatggtgagagtggagtgagga

SEQ ID NO: 8224 - DNA, 23 bp, Artificial Sequence
  Synthetic oligonucleotide
ggaagtctcaggatgagtgagga

SEQ ID NO: 8225 - DNA, 24 bp, Artificial Sequence
  Synthetic oligonucleotide
atcttggtcagggcagagtgagga

SEQ ID NO: 8226 - DNA, 23 bp, Artificial Sequence
  Synthetic oligonucleotide
atcaggtcccaattgagtgagga

SEQ ID NO: 8227 - DNA, 24 bp, Artificial Sequence
  Synthetic oligonucleotide
ggcatggtgtaaagagagtgagga

SEQ ID NO: 8228 - DNA, 23 bp, Artificial Sequence
  Synthetic oligonucleotide
tgaaacgttgcagggagtgagga

SEQ ID NO: 8229 - DNA, 23 bp, Artificial Sequence
  Synthetic oligonucleotide
tgaatcggcaacaagagtgagga

SEQ ID NO: 8230 - DNA, 23 bp, Artificial Sequence
  Synthetic oligonucleotide
atacacgtctcctggagtgagga

SEQ ID NO: 8231 - DNA, 23 bp, Artificial Sequence
  Synthetic oligonucleotide
gggaaggtccttgggagtgagga

SEQ ID NO: 8232 - DNA, 24 bp, Artificial Sequence
  Synthetic oligonucleotide
cactgtgtcgggtgagagtgagga

SEQ ID NO: 8233 - DNA, 23 bp, Artificial Sequence
  Synthetic oligonucleotide
atctttgtcttcctgagtgagga

SEQ ID NO: 8234 - DNA, 23 bp, Artificial Sequence
  Synthetic oligonucleotide
ctgagggtcattgggagtgagga

SEQ ID NO: 8235 - DNA, 23 bp, Artificial Sequence
  Synthetic oligonucleotide
atgtgagtcttcttgagtgagga

SEQ ID NO: 8236 - DNA, 24 bp, Artificial Sequence
  Synthetic oligonucleotide
aaagtcgtcagctatgagtgagga

SEQ ID NO: 8237 - DNA, 23 bp, Artificial Sequence
  Synthetic oligonucleotide
aacaatgttcgcctgagtgagga

SEQ ID NO: 8238 - DNA, 24 bp, Artificial Sequence
  Synthetic oligonucleotide
gggaaggtcctatgggagtgagga

SEQ ID NO: 8239 - DNA, 24 bp, Artificial Sequence
  Synthetic oligonucleotide
ggatgtgtcttcagggagtgagga

SEQ ID NO: 8240 - DNA, 23 bp, Artificial Sequence
  Synthetic oligonucleotide
tccacagtctgggtgagtgagga

SEQ ID NO: 8241 - DNA, 24 bp, Artificial Sequence
  Synthetic oligonucleotide
agcaaagctatatgggagtgagga

SEQ ID NO: 8242 - DNA, 24 bp, Artificial Sequence
  Synthetic oligonucleotide
ccctgggtcccaggggagtgagga

SEQ ID NO: 8243 - DNA, 24 bp, Artificial Sequence
  Synthetic oligonucleotide
gtgagggtctctggagagtgagga

SEQ ID NO: 8244 - DNA, 24 bp, Artificial Sequence
  Synthetic oligonucleotide
agccaggttgaaaaggagtgagga

SEQ ID NO: 8245 - DNA, 23 bp, Artificial Sequence
  Synthetic oligonucleotide
agcatggcttatgggagtgagga

SEQ ID NO: 8246 - DNA, 23 bp, Artificial Sequence
  Synthetic oligonucleotide
agctcaggcagggggagtgagga

SEQ ID NO: 8247 - DNA, 23 bp, Artificial Sequence
  Synthetic oligonucleotide
ccctgggtctgctggagtgagga

SEQ ID NO: 8248 - DNA, 23 bp, Artificial Sequence
  Synthetic oligonucleotide
agcaacagatgaaggagtgagga

SEQ ID NO: 8249 - DNA, 24 bp, Artificial Sequence
  Synthetic oligonucleotide
agcatggctggaatggagtgagga

SEQ ID NO: 8250 - DNA, 24 bp, Artificial Sequence
  Synthetic oligonucleotide
agctaagttcttgtagagtgagga

SEQ ID NO: 8251 - DNA, 23 bp, Artificial Sequence
  Synthetic oligonucleotide
aactttgtcctgaagagtgagga

SEQ ID NO: 8252 - DNA, 24 bp, Artificial Sequence
  Synthetic oligonucleotide
aacatggttccttctgagtgagga

SEQ ID NO: 8253 - DNA, 24 bp, Artificial Sequence
  Synthetic oligonucleotide
cgccacggctgggaggagtgagga

SEQ ID NO: 8254 - DNA, 23 bp, Artificial Sequence
  Synthetic oligonucleotide
ctcattgtccaggagagtgagga

SEQ ID NO: 8255 - DNA, 24 bp, Artificial Sequence
  Synthetic oligonucleotide
ccctgggtcatgtgagagtgagga

SEQ ID NO: 8256 - DNA, 24 bp, Artificial Sequence
  Synthetic oligonucleotide
agcaacgtcaaagatcactgatca

SEQ ID NO: 8257 - DNA, 24 bp, Artificial Sequence
  Synthetic oligonucleotide
agcagcggcgacagcagaggagga

SEQ ID NO: 8258 - DNA, 24 bp, Artificial Sequence
  Synthetic oligonucleotide
agcagcggcaagtgggagtaggat

SEQ ID NO: 8259 - DNA, 24 bp, Artificial Sequence
  Synthetic oligonucleotide
agcagcggcggcaccacgtgcgca

SEQ ID NO: 8260 - DNA, 24 bp, Artificial Sequence
  Synthetic oligonucleotide
agcaccgtcaatcaggtgcgagtc

SEQ ID NO: 8261 - DNA, 24 bp, Artificial Sequence
  Synthetic oligonucleotide
agcaccgtcaagagtcagtgttta

SEQ ID NO: 8262 - DNA, 24 bp, Artificial Sequence
  Synthetic oligonucleotide
agcacagtcacctctgagtgacac

SEQ ID NO: 8263 - DNA, 23 bp, Artificial Sequence
  Synthetic oligonucleotide
agcaacgtatcgatgagggtaga

SEQ ID NO: 8264 - DNA, 23 bp, Artificial Sequence
  Synthetic oligonucleotide
agcatcggcaggcagagtaagtc

SEQ ID NO: 8265 - DNA, 24 bp, Artificial Sequence
  Synthetic oligonucleotide
aacaacgtcctgaacgtgagagaa

SEQ ID NO: 8266 - DNA, 24 bp, Artificial Sequence
  Synthetic oligonucleotide
agcatagtccgtgtagtgagagaa

SEQ ID NO: 8267 - DNA, 24 bp, Artificial Sequence
  Synthetic oligonucleotide
agcatggtcttaatggagtgatag

SEQ ID NO: 8268 - DNA, 24 bp, Artificial Sequence
  Synthetic oligonucleotide
agctgtgtctgccttgggtgatgc

SEQ ID NO: 8269 - DNA, 23 bp, Artificial Sequence
  Synthetic oligonucleotide
agcaatgtcatgtccagtgagcc

SEQ ID NO: 8270 - DNA, 24 bp, Artificial Sequence
  Synthetic oligonucleotide
agcattgtccaaggagagtaagtg

SEQ ID NO: 8271 - DNA, 24 bp, Artificial Sequence
  Synthetic oligonucleotide
agcagctgctctcaagagtatggg

SEQ ID NO: 8272 - DNA, 24 bp, Artificial Sequence
  Synthetic oligonucleotide
tgcagtgtctggagtgtgtcaggc

SEQ ID NO: 8273 - DNA, 24 bp, Artificial Sequence
  Synthetic oligonucleotide
agcattgtcctcctctggtgaggt

SEQ ID NO: 8274 - DNA, 24 bp, Artificial Sequence
  Synthetic oligonucleotide
agcattgtcccaaaagtgagggga

SEQ ID NO: 8275 - DNA, 23 bp, Artificial Sequence
  Synthetic oligonucleotide
agcaatgtctaccacagtgagac

SEQ ID NO: 8276 - DNA, 24 bp, Artificial Sequence
  Synthetic oligonucleotide
agcaacgttctttatgtaagagga

SEQ ID NO: 8277 - DNA, 24 bp, Artificial Sequence
  Synthetic oligonucleotide
agcaacttcacttaggcgtgggaa

SEQ ID NO: 8278 - DNA, 24 bp, Artificial Sequence
  Synthetic oligonucleotide
aggcgagtctctttagtgtgaggc

SEQ ID NO: 8279 - DNA, 24 bp, Artificial Sequence
  Synthetic oligonucleotide
agccacgttaggggtaagtgaggg

SEQ ID NO: 8280 - DNA, 23 bp, Artificial Sequence
  Synthetic oligonucleotide
agtatcgtgattgaaagtgaggc

SEQ ID NO: 8281 - DNA, 23 bp, Artificial Sequence
  Synthetic oligonucleotide
agcaaggtagcttggagtgagac

SEQ ID NO: 8282 - DNA, 23 bp, Artificial Sequence
  Synthetic oligonucleotide
tgcagctgcaaaagaagtgaggg

SEQ ID NO: 8283 - DNA, 24 bp, Artificial Sequence
  Synthetic oligonucleotide
agtatcttctggtgtgagtgagat

SEQ ID NO: 8284 - DNA, 24 bp, Artificial Sequence
  Synthetic oligonucleotide
tgcagtttctcaaaggagagtgga

SEQ ID NO: 8285 - DNA, 24 bp, Artificial Sequence
  Synthetic oligonucleotide
atcaggggcccactagagtaaggg

SEQ ID NO: 8286 - DNA, 24 bp, Artificial Sequence
  Synthetic oligonucleotide
agttgcttctgcattgagtaacga

SEQ ID NO: 8287 - DNA, 24 bp, Artificial Sequence
  Synthetic oligonucleotide
agctacgtgcccggccagtgaggg

SEQ ID NO: 8288 - DNA, 23 bp, Artificial Sequence
  Synthetic oligonucleotide
agcttagtctgagtgtgtgaggt

SEQ ID NO: 8289 - DNA, 23 bp, Artificial Sequence
  Synthetic oligonucleotide
atcaggggctgaaggagtaaggg

SEQ ID NO: 8290 - DNA, 23 bp, Artificial Sequence
  Synthetic oligonucleotide
atcaggggctgaaggagtaaggg

SEQ ID NO: 8291 - DNA, 24 bp, Artificial Sequence
  Synthetic oligonucleotide
agcaacccctctgctgagggaggc

SEQ ID NO: 8292 - DNA, 24 bp, Artificial Sequence
  Synthetic oligonucleotide
agcatggtatgatgtaagtgaggg

SEQ ID NO: 8293 - DNA, 24 bp, Artificial Sequence
  Synthetic oligonucleotide
catagcgtcagattggagtaaggt

SEQ ID NO: 8294 - DNA, 24 bp, Artificial Sequence
  Synthetic oligonucleotide
tgcagctgctgtcagaagtgaggg

SEQ ID NO: 8295 - DNA, 23 bp, Artificial Sequence
  Synthetic oligonucleotide
agctaggtcccctgcagtgaggg

SEQ ID NO: 8296 - DNA, 24 bp, Artificial Sequence
  Synthetic oligonucleotide
agcttggtcagtgaagagagaggt

SEQ ID NO: 8297 - DNA, 24 bp, Artificial Sequence
  Synthetic oligonucleotide
agcaactacatatctgtgtgaggc

SEQ ID NO: 8298 - DNA, 24 bp, Artificial Sequence
  Synthetic oligonucleotide
agcaacccctctgctgagggaggc

SEQ ID NO: 8299 - DNA, 24 bp, Artificial Sequence
  Synthetic oligonucleotide
gtcagtgtcctggaaaagtgaggg

SEQ ID NO: 8300 - DNA, 24 bp, Artificial Sequence
  Synthetic oligonucleotide
tgcagtgtagctggagagggaggt

SEQ ID NO: 8301 - DNA, 24 bp, Artificial Sequence
  Synthetic oligonucleotide
ctcatcgtccaggctgagtgagtc

SEQ ID NO: 8302 - DNA, 24 bp, Artificial Sequence
  Synthetic oligonucleotide
agtaacatcaagtcatagtgaggc

SEQ ID NO: 8303 - DNA, 24 bp, Artificial Sequence
  Synthetic oligonucleotide
agctatgtcctaaagaagtgaggg

SEQ ID NO: 8304 - DNA, 24 bp, Artificial Sequence
  Synthetic oligonucleotide
gtccgcgtcttgtttgagtaaggg

SEQ ID NO: 8305 - DNA, 23 bp, Artificial Sequence
  Synthetic oligonucleotide
agccttgtcactgaaagtgaggc

SEQ ID NO: 8306 - DNA, 24 bp, Artificial Sequence
  Synthetic oligonucleotide
agcacagccacatctgtgtgaggc

SEQ ID NO: 8307 - DNA, 24 bp, Artificial Sequence
  Synthetic oligonucleotide
agcaacattctaagcgagtgagtc

SEQ ID NO: 8308 - DNA, 24 bp, Artificial Sequence
  Synthetic oligonucleotide
agtgtggtcggagcagagtgaggg

SEQ ID NO: 8309 - DNA, 24 bp, Artificial Sequence
  Synthetic oligonucleotide
actaatgtcatgctagagtgaggt

SEQ ID NO: 8310 - DNA, 24 bp, Artificial Sequence
  Synthetic oligonucleotide
tacattgtctaggaggagtgaggg

SEQ ID NO: 8311 - DNA, 23 bp, Artificial Sequence
  Synthetic oligonucleotide
atcaatggccagatgagtgaggg

SEQ ID NO: 8312 - DNA, 24 bp, Artificial Sequence
  Synthetic oligonucleotide
cggggagtcccaggggagtgaggg

SEQ ID NO: 8313 - DNA, 23 bp, Artificial Sequence
  Synthetic oligonucleotide
agcaggtcacatcggagtgaggg

SEQ ID NO: 8314 - DNA, 23 bp, Artificial Sequence
  Synthetic oligonucleotide
agctaggttggcccgagtgaggc

SEQ ID NO: 8315 - DNA, 24 bp, Artificial Sequence
  Synthetic oligonucleotide
agtgtggtcagagagaagtgagga

SEQ ID NO: 8316 - DNA, 24 bp, Artificial Sequence
  Synthetic oligonucleotide
agtatggtaacagcagagtgaggg

SEQ ID NO: 8317 - DNA, 23 bp, Artificial Sequence
  Synthetic oligonucleotide
atccgtctcttctggtgtgagga

SEQ ID NO: 8318 - DNA, 23 bp, Artificial Sequence
  Synthetic oligonucleotide
aacagtattgcaatgagtgaggg

SEQ ID NO: 8319 - DNA, 23 bp, Artificial Sequence
  Synthetic oligonucleotide
atcagcagtgaacaaagtgagga

SEQ ID NO: 8320 - DNA, 23 bp, Artificial Sequence
  Synthetic oligonucleotide
ggccaagtcagcgggagtgaggc

SEQ ID NO: 8321 - DNA, 23 bp, Artificial Sequence
  Synthetic oligonucleotide
gccagtgtttctcagagtgaggt

SEQ ID NO: 8322 - DNA, 24 bp, Artificial Sequence
  Synthetic oligonucleotide
atcagggcaggccaggagtgaggg

SEQ ID NO: 8323 - DNA, 23 bp, Artificial Sequence
  Synthetic oligonucleotide
agtagatgcagttagagtgaggt

SEQ ID NO: 8324 - DNA, 24 bp, Artificial Sequence
  Synthetic oligonucleotide
ggcctggtcaggagggagtgaggg

SEQ ID NO: 8325 - DNA, 24 bp, Artificial Sequence
  Synthetic oligonucleotide
agcaactcattctgtgagtgaggg

SEQ ID NO: 8326 - DNA, 24 bp, Artificial Sequence
  Synthetic oligonucleotide
gggggagtcttgcgggagtgaggt

SEQ ID NO: 8327 - DNA, 24 bp, Artificial Sequence
  Synthetic oligonucleotide
atcagtctagcagcagagtgaggc

SEQ ID NO: 8328 - DNA, 23 bp, Artificial Sequence
  Synthetic oligonucleotide
agtagatgcatagggagtgaggt

SEQ ID NO: 8329 - DNA, 24 bp, Artificial Sequence
  Synthetic oligonucleotide
accagtggtgggggtgagtgaggt

SEQ ID NO: 8330 - DNA, 23 bp, Artificial Sequence
  Synthetic oligonucleotide
ggccttgtcccctagagtgaggg

SEQ ID NO: 8331 - DNA, 24 bp, Artificial Sequence
  Synthetic oligonucleotide
ctcattgtcttgctggagtgaggc

SEQ ID NO: 8332 - DNA, 24 bp, Artificial Sequence
  Synthetic oligonucleotide
agtatggtaaaaggagagtgaggg

SEQ ID NO: 8333 - DNA, 24 bp, Artificial Sequence
  Synthetic oligonucleotide
agagaggtcagggtagagtgaggg

SEQ ID NO: 8334 - DNA, 24 bp, Artificial Sequence
  Synthetic oligonucleotide
ggcctggtcagatttgagtgaggg

SEQ ID NO: 8335 - DNA, 24 bp, Artificial Sequence
  Synthetic oligonucleotide
tgttgagtccgtatggagtgaggg

SEQ ID NO: 8336 - DNA, 23 bp, Artificial Sequence
  Synthetic oligonucleotide
agcaccactgacaggagtgaggg

SEQ ID NO: 8337 - DNA, 23 bp, Artificial Sequence
  Synthetic oligonucleotide
aaaacagtcatcctgagtgaggg

SEQ ID NO: 8338 - DNA, 23 bp, Artificial Sequence
  Synthetic oligonucleotide
aacagtattaaggagagtgaggg

SEQ ID NO: 8339 - DNA, 23 bp, Artificial Sequence
  Synthetic oligonucleotide
gccaacatccacatgagtgaggt

SEQ ID NO: 8340 - DNA, 23 bp, Artificial Sequence
  Synthetic oligonucleotide
ggccaagtctctcagagtgaggc

SEQ ID NO: 8341 - DNA, 24 bp, Artificial Sequence
  Synthetic oligonucleotide
aaaacagtctttcgagagtgaggg

SEQ ID NO: 8342 - DNA, 23 bp, Artificial Sequence
  Synthetic oligonucleotide
aatcccgtcatggagagtgaggt

SEQ ID NO: 8343 - DNA, 23 bp, Artificial Sequence
  Synthetic oligonucleotide
ggttacgtccggaaaagtgaggc

SEQ ID NO: 8344 - DNA, 23 bp, Artificial Sequence
  Synthetic oligonucleotide
agttacttctataaaagtgaggg

SEQ ID NO: 8345 - DNA, 23 bp, Artificial Sequence
  Synthetic oligonucleotide
agttacttccctcaaagtgaggg

SEQ ID NO: 8346 - DNA, 23 bp, Artificial Sequence
  Synthetic oligonucleotide
ggcatcgtccactccagtgagga

SEQ ID NO: 8347 - DNA, 23 bp, Artificial Sequence
  Synthetic oligonucleotide
atcagggtccagctcagtgaggc

SEQ ID NO: 8348 - DNA, 24 bp, Artificial Sequence
  Synthetic oligonucleotide
agctcagtcactcctgagtgaggg

SEQ ID NO: 8349 - DNA, 23 bp, Artificial Sequence
  Synthetic oligonucleotide
agctcagtcctggggagtgaggg

SEQ ID NO: 8350 - DNA, 23 bp, Artificial Sequence
  Synthetic oligonucleotide
agcatggttttctggagtgaggc

SEQ ID NO: 8351 - DNA, 23 bp, Artificial Sequence
  Synthetic oligonucleotide
agatgggtcttgctgagtgaggc

SEQ ID NO: 8352 - DNA, 23 bp, Artificial Sequence
  Synthetic oligonucleotide
agatgggtcttgctgagtgaggc

SEQ ID NO: 8353 - DNA, 23 bp, Artificial Sequence
  Synthetic oligonucleotide
agcagagtcaggatgaatgagga

SEQ ID NO: 8354 - DNA, 23 bp, Artificial Sequence
  Synthetic oligonucleotide
agcagagtcatgaagattgagga

SEQ ID NO: 8355 - DNA, 24 bp, Artificial Sequence
  Synthetic oligonucleotide
agcagcgtctgaaagtagagatga

SEQ ID NO: 8356 - DNA, 24 bp, Artificial Sequence
  Synthetic oligonucleotide
agcagcgtcagcttcaagtatgga

SEQ ID NO: 8357 - DNA, 24 bp, Artificial Sequence
  Synthetic oligonucleotide
agcagcgtcaacatttagtaatga

SEQ ID NO: 8358 - DNA, 24 bp, Artificial Sequence
  Synthetic oligonucleotide
agcagcgtcaacatttagtaatga

SEQ ID NO: 8359 - DNA, 24 bp, Artificial Sequence
  Synthetic oligonucleotide
agcagtgtcttaggaaagagagga

SEQ ID NO: 8360 - DNA, 24 bp, Artificial Sequence
  Synthetic oligonucleotide
agcagcttcagatgggagagagaa

SEQ ID NO: 8361 - DNA, 23 bp, Artificial Sequence
  Synthetic oligonucleotide
agcagtgtccagcaaagagagga

SEQ ID NO: 8362 - DNA, 23 bp, Artificial Sequence
  Synthetic oligonucleotide
tgcagcgtcaatgtgagtgaaaa

SEQ ID NO: 8363 - DNA, 24 bp, Artificial Sequence
  Synthetic oligonucleotide
agcagtgtcaggtatgagagggga

SEQ ID NO: 8364 - DNA, 23 bp, Artificial Sequence
  Synthetic oligonucleotide
agcagcttcagggagagtgtggg

SEQ ID NO: 8365 - DNA, 24 bp, Artificial Sequence
  Synthetic oligonucleotide
agcagtgtccttgccgaaggagga

SEQ ID NO: 8366 - DNA, 24 bp, Artificial Sequence
  Synthetic oligonucleotide
agcagcttcatgaaggagagagaa

SEQ ID NO: 8367 - DNA, 23 bp, Artificial Sequence
  Synthetic oligonucleotide
agcagcgtggaggtgagtggggt

SEQ ID NO: 8368 - DNA, 24 bp, Artificial Sequence
  Synthetic oligonucleotide
agcagcgttactcaggagagagaa

SEQ ID NO: 8369 - DNA, 23 bp, Artificial Sequence
  Synthetic oligonucleotide
agaagcgtcactgagagtgagtt

SEQ ID NO: 8370 - DNA, 23 bp, Artificial Sequence
  Synthetic oligonucleotide
agcagcatcttgaggggtgaggc

SEQ ID NO: 8371 - DNA, 23 bp, Artificial Sequence
  Synthetic oligonucleotide
agcagcggcacaaagagggacga

SEQ ID NO: 8372 - DNA, 23 bp, Artificial Sequence
  Synthetic oligonucleotide
agcatcgtctgaaggggtgagca

SEQ ID NO: 8373 - DNA, 23 bp, Artificial Sequence
  Synthetic oligonucleotide
agcagcttccaccagagggagta

SEQ ID NO: 8374 - DNA, 24 bp, Artificial Sequence
  Synthetic oligonucleotide
agcagcgttctgtctaagtgaaga

SEQ ID NO: 8375 - DNA, 24 bp, Artificial Sequence
  Synthetic oligonucleotide
agcagcatctgcttcgggtgaggc

SEQ ID NO: 8376 - DNA, 23 bp, Artificial Sequence
  Synthetic oligonucleotide
agcagggtcggggagggtgagaa

SEQ ID NO: 8377 - DNA, 24 bp, Artificial Sequence
  Synthetic oligonucleotide
agcagggtcagctgggagtaagaa

SEQ ID NO: 8378 - DNA, 24 bp, Artificial Sequence
  Synthetic oligonucleotide
agcagcgccggaagagagcgaggg

SEQ ID NO: 8379 - DNA, 23 bp, Artificial Sequence
  Synthetic oligonucleotide
agcaccgtccctaagactgagca

SEQ ID NO: 8380 - DNA, 24 bp, Artificial Sequence
  Synthetic oligonucleotide
agcagagtcacagctgaatgaggc

SEQ ID NO: 8381 - DNA, 24 bp, Artificial Sequence
  Synthetic oligonucleotide
agcagcgtggacccaaagagagga

SEQ ID NO: 8382 - DNA, 23 bp, Artificial Sequence
  Synthetic oligonucleotide
agcagggtccacatgagtcaggg

SEQ ID NO: 8383 - DNA, 24 bp, Artificial Sequence
  Synthetic oligonucleotide
agcagggtcggggtggagggagaa

SEQ ID NO: 8384 - DNA, 24 bp, Artificial Sequence
  Synthetic oligonucleotide
ggcagcgtccaggtagactgaggg

SEQ ID NO: 8385 - DNA, 24 bp, Artificial Sequence
  Synthetic oligonucleotide
agcagtgtcctaaaggaaggagga

SEQ ID NO: 8386 - DNA, 23 bp, Artificial Sequence
  Synthetic oligonucleotide
agcagcctcttctgtaatgagga

SEQ ID NO: 8387 - DNA, 23 bp, Artificial Sequence
  Synthetic oligonucleotide
agcagcgttgggaagagagagaa

SEQ ID NO: 8388 - DNA, 24 bp, Artificial Sequence
  Synthetic oligonucleotide
agcagcgacagggcagaatgaggc

SEQ ID NO: 8389 - DNA, 23 bp, Artificial Sequence
  Synthetic oligonucleotide
agcagagtcgagcaaggtgagga

SEQ ID NO: 8390 - DNA, 24 bp, Artificial Sequence
  Synthetic oligonucleotide
agcagcatcgagtggaagtgggga

SEQ ID NO: 8391 - DNA, 23 bp, Artificial Sequence
  Synthetic oligonucleotide
agctgagtccagaagagtgggga

SEQ ID NO: 8392 - DNA, 23 bp, Artificial Sequence
  Synthetic oligonucleotide
ggcagtgtcagtaggtgtgagga

SEQ ID NO: 8393 - DNA, 23 bp, Artificial Sequence
  Synthetic oligonucleotide
agcaacttcagaatgagttagga

SEQ ID NO: 8394 - DNA, 23 bp, Artificial Sequence
  Synthetic oligonucleotide
agcatcttcagctatagtgagga

SEQ ID NO: 8395 - DNA, 24 bp, Artificial Sequence
  Synthetic oligonucleotide
ggcagggtcacccgaaagtgagga

SEQ ID NO: 8396 - DNA, 24 bp, Artificial Sequence
  Synthetic oligonucleotide
agcagtgtgtgcccagagtgagta

SEQ ID NO: 8397 - DNA, 24 bp, Artificial Sequence
  Synthetic oligonucleotide
agcagtgtaccatgcgagtgagca

SEQ ID NO: 8398 - DNA, 24 bp, Artificial Sequence
  Synthetic oligonucleotide
agctgggtctatttggagtcagga

SEQ ID NO: 8399 - DNA, 23 bp, Artificial Sequence
  Synthetic oligonucleotide
agcagcgaggtggggagtgagta

SEQ ID NO: 8400 - DNA, 24 bp, Artificial Sequence
  Synthetic oligonucleotide
agcagcttggattcagagtgagaa

SEQ ID NO: 8401 - DNA, 24 bp, Artificial Sequence
  Synthetic oligonucleotide
agcagcagcaacgaggagcgagga

SEQ ID NO: 8402 - DNA, 24 bp, Artificial Sequence
  Synthetic oligonucleotide
agcaccatctttgaaaagtgagga

SEQ ID NO: 8403 - DNA, 24 bp, Artificial Sequence
  Synthetic oligonucleotide
agcagagtttgaattgagttagga

SEQ ID NO: 8404 - DNA, 23 bp, Artificial Sequence
  Synthetic oligonucleotide
ggcagggtcaaggaaagtgagga

SEQ ID NO: 8405 - DNA, 24 bp, Artificial Sequence
  Synthetic oligonucleotide
ggcagtgtccaggaggtgtgagga

SEQ ID NO: 8406 - DNA, 24 bp, Artificial Sequence
  Synthetic oligonucleotide
tgcaacgtcacaagtgagagagga

SEQ ID NO: 8407 - DNA, 24 bp, Artificial Sequence
  Synthetic oligonucleotide
aacagtgtctttcaaaagtgagga

SEQ ID NO: 8408 - DNA, 24 bp, Artificial Sequence
  Synthetic oligonucleotide
agcagtgtagacccagagtgagca

SEQ ID NO: 8409 - DNA, 23 bp, Artificial Sequence
  Synthetic oligonucleotide
agctgtgtccccttgagagagga

SEQ ID NO: 8410 - DNA, 24 bp, Artificial Sequence
  Synthetic oligonucleotide
agcagcggaggtggggagggagga

SEQ ID NO: 8411 - DNA, 23 bp, Artificial Sequence
  Synthetic oligonucleotide
aacagcttctcattgagtgagta

SEQ ID NO: 8412 - DNA, 24 bp, Artificial Sequence
  Synthetic oligonucleotide
agtagagtcaggcctgaatgagga

SEQ ID NO: 8413 - DNA, 23 bp, Artificial Sequence
  Synthetic oligonucleotide
agcagcgaagccggaagtgagga

SEQ ID NO: 8414 - DNA, 23 bp, Artificial Sequence
  Synthetic oligonucleotide
aactgcgtcccaggaagtgagga

SEQ ID NO: 8415 - DNA, 24 bp, Artificial Sequence
  Synthetic oligonucleotide
agaagcctctgctatgagtgaggc

SEQ ID NO: 8416 - DNA, 23 bp, Artificial Sequence
  Synthetic oligonucleotide
agcagtgtgcaatggagtgagta

SEQ ID NO: 8417 - DNA, 23 bp, Artificial Sequence
  Synthetic oligonucleotide
agtagagtccctgggagtgagca

SEQ ID NO: 8418 - DNA, 24 bp, Artificial Sequence
  Synthetic oligonucleotide
ggcagtgtcatgtgtgagggagga

SEQ ID NO: 8419 - DNA, 24 bp, Artificial Sequence
  Synthetic oligonucleotide
agcactgtcactgttgagtgatga

SEQ ID NO: 8420 - DNA, 24 bp, Artificial Sequence
  Synthetic oligonucleotide
agctgggtctgggaggagtcagga

SEQ ID NO: 8421 - DNA, 24 bp, Artificial Sequence
  Synthetic oligonucleotide
agcagctttccaagagagtgagaa

SEQ ID NO: 8422 - DNA, 24 bp, Artificial Sequence
  Synthetic oligonucleotide
agcagtgtagacccagagtgagca

SEQ ID NO: 8423 - DNA, 24 bp, Artificial Sequence
  Synthetic oligonucleotide
ggcagcgtggggatgcagtgagga

SEQ ID NO: 8424 - DNA, 23 bp, Artificial Sequence
  Synthetic oligonucleotide
agcagcagcagagggagcgagga

SEQ ID NO: 8425 - DNA, 23 bp, Artificial Sequence
  Synthetic oligonucleotide
agtagcttccctctgtgtgagga

SEQ ID NO: 8426 - DNA, 24 bp, Artificial Sequence
  Synthetic oligonucleotide
tgcggcgtctcctgggagtgaaga

SEQ ID NO: 8427 - DNA, 23 bp, Artificial Sequence
  Synthetic oligonucleotide
aacagagtctggcagagtgagca

SEQ ID NO: 8428 - DNA, 23 bp, Artificial Sequence
  Synthetic oligonucleotide
ggcagcggcctggggagtgtgga

SEQ ID NO: 8429 - DNA, 23 bp, Artificial Sequence
  Synthetic oligonucleotide
agcaggctccttgttagtgagga

SEQ ID NO: 8430 - DNA, 24 bp, Artificial Sequence
  Synthetic oligonucleotide
atcaccatcatacctgagtgagga

SEQ ID NO: 8431 - DNA, 23 bp, Artificial Sequence
  Synthetic oligonucleotide
agcagtttaattctgagtgagga

SEQ ID NO: 8432 - DNA, 23 bp, Artificial Sequence
  Synthetic oligonucleotide
aacagcaacaaaaagagtgagga

SEQ ID NO: 8433 - DNA, 23 bp, Artificial Sequence
  Synthetic oligonucleotide
agctgagtagaatggagtgagga

SEQ ID NO: 8434 - DNA, 23 bp, Artificial Sequence
  Synthetic oligonucleotide
agcaacctggggctgagtgagga

SEQ ID NO: 8435 - DNA, 23 bp, Artificial Sequence
  Synthetic oligonucleotide
agcaacctggaaaagagtgagga

SEQ ID NO: 8436 - DNA, 23 bp, Artificial Sequence
  Synthetic oligonucleotide
tgcaggctcctgtggagtgagga

SEQ ID NO: 8437 - DNA, 23 bp, Artificial Sequence
  Synthetic oligonucleotide
cgcagtatcccactgagtgagga

SEQ ID NO: 8438 - DNA, 23 bp, Artificial Sequence
  Synthetic oligonucleotide
agaaacatcagatggagtgagga

SEQ ID NO: 8439 - DNA, 23 bp, Artificial Sequence
  Synthetic oligonucleotide
acctgtgtctcctggagtgagga

SEQ ID NO: 8440 - DNA, 24 bp, Artificial Sequence
  Synthetic oligonucleotide
ggcagggcctcaagggagtgagga

SEQ ID NO: 8441 - DNA, 24 bp, Artificial Sequence
  Synthetic oligonucleotide
agaaacatctaagaggagtgagga

SEQ ID NO: 8442 - DNA, 23 bp, Artificial Sequence
  Synthetic oligonucleotide
aggtgcatccctcagagtgagga

SEQ ID NO: 8443 - DNA, 23 bp, Artificial Sequence
  Synthetic oligonucleotide
ggcagggccttcttgagtgagga

SEQ ID NO: 8444 - DNA, 23 bp, Artificial Sequence
  Synthetic oligonucleotide
ggcagctgctttttgagtgagga

SEQ ID NO: 8445 - DNA, 24 bp, Artificial Sequence
  Synthetic oligonucleotide
agcatggcccaggaggagtgagga

SEQ ID NO: 8446 - DNA, 24 bp, Artificial Sequence
  Synthetic oligonucleotide
agcagcgtcttcagcaagtggagg

SEQ ID NO: 8447 - DNA, 24 bp, Artificial Sequence
  Synthetic oligonucleotide
agcagcgtctggggcagtggagga

SEQ ID NO: 8448 - DNA, 23 bp, Artificial Sequence
  Synthetic oligonucleotide
agcagcgtctcatagagttaacc

SEQ ID NO: 8449 - DNA, 23 bp, Artificial Sequence
  Synthetic oligonucleotide
agcagcgtccctgaaattgtgca

SEQ ID NO: 8450 - DNA, 24 bp, Artificial Sequence
  Synthetic oligonucleotide
agcaacgtcagggaagagggacca

SEQ ID NO: 8451 - DNA, 24 bp, Artificial Sequence
  Synthetic oligonucleotide
agcagggtccactcagagggagtc

SEQ ID NO: 8452 - DNA, 23 bp, Artificial Sequence
  Synthetic oligonucleotide
agcagcgtgtggctgtgtgtggc

SEQ ID NO: 8453 - DNA, 24 bp, Artificial Sequence
  Synthetic oligonucleotide
agcagcgttggctgaaactgaggt

SEQ ID NO: 8454 - DNA, 24 bp, Artificial Sequence
  Synthetic oligonucleotide
agcaacgtctccagggactgaagc

SEQ ID NO: 8455 - DNA, 24 bp, Artificial Sequence
  Synthetic oligonucleotide
agcagggtcatttaggagtgacat

SEQ ID NO: 8456 - DNA, 24 bp, Artificial Sequence
  Synthetic oligonucleotide
agcagtgtcttgtcagagtgtgtc

SEQ ID NO: 8457 - DNA, 24 bp, Artificial Sequence
  Synthetic oligonucleotide
agcaacgtcctcaaggaggcaaga

SEQ ID NO: 8458 - DNA, 24 bp, Artificial Sequence
  Synthetic oligonucleotide
agcatcgtccacctggcgagaggc

SEQ ID NO: 8459 - DNA, 23 bp, Artificial Sequence
  Synthetic oligonucleotide
agcagcttctaacaaagtgagac

SEQ ID NO: 8460 - DNA, 24 bp, Artificial Sequence
  Synthetic oligonucleotide
agcaacgtcagggaggagagggca

SEQ ID NO: 8461 - DNA, 23 bp, Artificial Sequence
  Synthetic oligonucleotide
agcagcgttttcatgtgtgtgta

SEQ ID NO: 8462 - DNA, 23 bp, Artificial Sequence
  Synthetic oligonucleotide
agcagcgtttaactgagtgaaag

SEQ ID NO: 8463 - DNA, 23 bp, Artificial Sequence
  Synthetic oligonucleotide
agcagggtcagcaggagggagtc

SEQ ID NO: 8464 - DNA, 23 bp, Artificial Sequence
  Synthetic oligonucleotide
agcagtgtcattacgagtgcgac

SEQ ID NO: 8465 - DNA, 23 bp, Artificial Sequence
  Synthetic oligonucleotide
agcagtgtcagtgcaagtgcggg

SEQ ID NO: 8466 - DNA, 23 bp, Artificial Sequence
  Synthetic oligonucleotide
agcagcttccatcgtggtgtgga

SEQ ID NO: 8467 - DNA, 23 bp, Artificial Sequence
  Synthetic oligonucleotide
ggcagcgtctaggggtgtgataa

SEQ ID NO: 8468 - DNA, 23 bp, Artificial Sequence
  Synthetic oligonucleotide
agcagcttccggtcgagtgattt

SEQ ID NO: 8469 - DNA, 24 bp, Artificial Sequence
  Synthetic oligonucleotide
agcagggtccggcttgtgtgcggc

SEQ ID NO: 8470 - DNA, 23 bp, Artificial Sequence
  Synthetic oligonucleotide
agcagcggcaagaagagggtggt

SEQ ID NO: 8471 - DNA, 23 bp, Artificial Sequence
  Synthetic oligonucleotide
agcagcctcactcagagtgggac

SEQ ID NO: 8472 - DNA, 24 bp, Artificial Sequence
  Synthetic oligonucleotide
agcaacgtctccacagagacaggc

SEQ ID NO: 8473 - DNA, 24 bp, Artificial Sequence
  Synthetic oligonucleotide
agcagcgtggggggagtgtggggg

SEQ ID NO: 8474 - DNA, 24 bp, Artificial Sequence
  Synthetic oligonucleotide
agcagggtctgcagggactgagag

SEQ ID NO: 8475 - DNA, 23 bp, Artificial Sequence
  Synthetic oligonucleotide
agcagtgtcttttccagtaaggt

SEQ ID NO: 8476 - DNA, 24 bp, Artificial Sequence
  Synthetic oligonucleotide
agcagcggcaagcacaagcaagga

SEQ ID NO: 8477 - DNA, 24 bp, Artificial Sequence
  Synthetic oligonucleotide
agcagcttcctccaggggagaggt

SEQ ID NO: 8478 - DNA, 24 bp, Artificial Sequence
  Synthetic oligonucleotide
agcagcttcgcctgctggtgtgga

SEQ ID NO: 8479 - DNA, 24 bp, Artificial Sequence
  Synthetic oligonucleotide
agcagcgactcacacaagtgagat

SEQ ID NO: 8480 - DNA, 24 bp, Artificial Sequence
  Synthetic oligonucleotide
agcagcggccccagcgagtgtgtc

SEQ ID NO: 8481 - DNA, 24 bp, Artificial Sequence
  Synthetic oligonucleotide
agcagtgtctgcaactagtgagct

SEQ ID NO: 8482 - DNA, 24 bp, Artificial Sequence
  Synthetic oligonucleotide
agcagcggcctggggacgagagga

SEQ ID NO: 8483 - DNA, 23 bp, Artificial Sequence
  Synthetic oligonucleotide
agcagcggctgccagagggtggt

SEQ ID NO: 8484 - DNA, 24 bp, Artificial Sequence
  Synthetic oligonucleotide
agcaacgtccattctgaggcaaga

SEQ ID NO: 8485 - DNA, 24 bp, Artificial Sequence
  Synthetic oligonucleotide
agcattgtcggattctggtgagga

SEQ ID NO: 8486 - DNA, 23 bp, Artificial Sequence
  Synthetic oligonucleotide
agcatggtcacaaagggtgaggt

SEQ ID NO: 8487 - DNA, 23 bp, Artificial Sequence
  Synthetic oligonucleotide
agcaacatcacagagagagaggg

SEQ ID NO: 8488 - DNA, 23 bp, Artificial Sequence
  Synthetic oligonucleotide
agcaatgtcccttggagtgtggg

SEQ ID NO: 8489 - DNA, 23 bp, Artificial Sequence
  Synthetic oligonucleotide
agcagctgccagaggagggaggc

SEQ ID NO: 8490 - DNA, 23 bp, Artificial Sequence
  Synthetic oligonucleotide
agctgggtcctagaaagtgaggt

SEQ ID NO: 8491 - DNA, 23 bp, Artificial Sequence
  Synthetic oligonucleotide
agcagctgcagtgagagtgagct

SEQ ID NO: 8492 - DNA, 23 bp, Artificial Sequence
  Synthetic oligonucleotide
agcattgtcaatgacagtgagaa

SEQ ID NO: 8493 - DNA, 23 bp, Artificial Sequence
  Synthetic oligonucleotide
agcaaagtctaagagagtgtggc

SEQ ID NO: 8494 - DNA, 23 bp, Artificial Sequence
  Synthetic oligonucleotide
agcagggtggagaagagcgaggg

SEQ ID NO: 8495 - DNA, 24 bp, Artificial Sequence
  Synthetic oligonucleotide
atcaacgtcctttgagagaaagga

SEQ ID NO: 8496 - DNA, 23 bp, Artificial Sequence
  Synthetic oligonucleotide
agcagcttttttccgagtgagag

SEQ ID NO: 8497 - DNA, 24 bp, Artificial Sequence
  Synthetic oligonucleotide
ggcagcgtttcctgtgagcaagga

SEQ ID NO: 8498 - DNA, 23 bp, Artificial Sequence
  Synthetic oligonucleotide
agcaccatcaggaggagggaggg

SEQ ID NO: 8499 - DNA, 23 bp, Artificial Sequence
  Synthetic oligonucleotide
atcagagtctgcaggcgtgaggc

SEQ ID NO: 8500 - DNA, 24 bp, Artificial Sequence
  Synthetic oligonucleotide
agcaccggcctcttggagggaggt

SEQ ID NO: 8501 - DNA, 23 bp, Artificial Sequence
  Synthetic oligonucleotide
ggcagggtcagtgggagtgagtc

SEQ ID NO: 8502 - DNA, 24 bp, Artificial Sequence
  Synthetic oligonucleotide
agcaccttctcctggtagtgaggc

SEQ ID NO: 8503 - DNA, 24 bp, Artificial Sequence
  Synthetic oligonucleotide
agcggtgtcatccaggagtgagcg

SEQ ID NO: 8504 - DNA, 23 bp, Artificial Sequence
  Synthetic oligonucleotide
agcaatgtctataaaagtgaggc

SEQ ID NO: 8505 - DNA, 23 bp, Artificial Sequence
  Synthetic oligonucleotide
agcagggtaagtacaagtgaggc

SEQ ID NO: 8506 - DNA, 23 bp, Artificial Sequence
  Synthetic oligonucleotide
agcaacgtgatcgggagggaggg

SEQ ID NO: 8507 - DNA, 23 bp, Artificial Sequence
  Synthetic oligonucleotide
agcagggtagatgggagagaggg

SEQ ID NO: 8508 - DNA, 23 bp, Artificial Sequence
  Synthetic oligonucleotide
agcaatgtctgggtgagtgtggg

SEQ ID NO: 8509 - DNA, 23 bp, Artificial Sequence
  Synthetic oligonucleotide
agcaatgtctgaaatagtgagta

SEQ ID NO: 8510 - DNA, 24 bp, Artificial Sequence
  Synthetic oligonucleotide
tgcagagtcaaggaagagtgagat

SEQ ID NO: 8511 - DNA, 24 bp, Artificial Sequence
  Synthetic oligonucleotide
agcatagtctcctaggagagaggc

SEQ ID NO: 8512 - DNA, 23 bp, Artificial Sequence
  Synthetic oligonucleotide
agcagggtaatggggagagaggg

SEQ ID NO: 8513 - DNA, 23 bp, Artificial Sequence
  Synthetic oligonucleotide
atcaccgtcgaggggagggaggg

SEQ ID NO: 8514 - DNA, 24 bp, Artificial Sequence
  Synthetic oligonucleotide
ggcagcttcggtgtccagtgaggc

SEQ ID NO: 8515 - DNA, 24 bp, Artificial Sequence
  Synthetic oligonucleotide
agctgggtctcattgcagtgaggt

SEQ ID NO: 8516 - DNA, 23 bp, Artificial Sequence
  Synthetic oligonucleotide
agcaacgtactgttaagtgagaa

SEQ ID NO: 8517 - DNA, 23 bp, Artificial Sequence
  Synthetic oligonucleotide
agcaaagtcaagaagagtgaaaa

SEQ ID NO: 8518 - DNA, 23 bp, Artificial Sequence
  Synthetic oligonucleotide
ggcagggtctctcaaagtgaggt

SEQ ID NO: 8519 - DNA, 24 bp, Artificial Sequence
  Synthetic oligonucleotide
tgcagggtcatgcaagtgtgaggt

SEQ ID NO: 8520 - DNA, 24 bp, Artificial Sequence
  Synthetic oligonucleotide
agcaaagtcagagctgagtgagcc

SEQ ID NO: 8521 - DNA, 24 bp, Artificial Sequence
  Synthetic oligonucleotide
ggcagtgtcatttttgagtaaggg

SEQ ID NO: 8522 - DNA, 23 bp, Artificial Sequence
  Synthetic oligonucleotide
agcagctgctgtgggagggaggc

SEQ ID NO: 8523 - DNA, 24 bp, Artificial Sequence
  Synthetic oligonucleotide
agcagcggtggtatctagtgaggc

SEQ ID NO: 8524 - DNA, 24 bp, Artificial Sequence
  Synthetic oligonucleotide
agcaacatctggaacgagtgaata

SEQ ID NO: 8525 - DNA, 23 bp, Artificial Sequence
  Synthetic oligonucleotide
agcagtgtgatcttgagtaaggc

SEQ ID NO: 8526 - DNA, 23 bp, Artificial Sequence
  Synthetic oligonucleotide
ggcagcttcagcaccagtgaggc

SEQ ID NO: 8527 - DNA, 24 bp, Artificial Sequence
  Synthetic oligonucleotide
agcagagttgcttaagagtgagag

SEQ ID NO: 8528 - DNA, 24 bp, Artificial Sequence
  Synthetic oligonucleotide
agcaccttctgccaagagtgagat

SEQ ID NO: 8529 - DNA, 23 bp, Artificial Sequence
  Synthetic oligonucleotide
agcagctgcgggcagagtgagct

SEQ ID NO: 8530 - DNA, 24 bp, Artificial Sequence
  Synthetic oligonucleotide
agtagagtctttgttgtgtgaggt

SEQ ID NO: 8531 - DNA, 24 bp, Artificial Sequence
  Synthetic oligonucleotide
agcatggtcgttggggggtgaggc

SEQ ID NO: 8532 - DNA, 24 bp, Artificial Sequence
  Synthetic oligonucleotide
agcattgtctcttgtgtgtgaggt

SEQ ID NO: 8533 - DNA, 24 bp, Artificial Sequence
  Synthetic oligonucleotide
atcagagtcaatttgtagtgaggt

SEQ ID NO: 8534 - DNA, 23 bp, Artificial Sequence
  Synthetic oligonucleotide
agcagcttagaggggagagaggt

SEQ ID NO: 8535 - DNA, 23 bp, Artificial Sequence
  Synthetic oligonucleotide
gacagcgtcctccggggtgaggc

SEQ ID NO: 8536 - DNA, 24 bp, Artificial Sequence
  Synthetic oligonucleotide
tgcagagtcagccctgagtgagat

SEQ ID NO: 8537 - DNA, 23 bp, Artificial Sequence
  Synthetic oligonucleotide
agcagagttggaaggagtgagag

SEQ ID NO: 8538 - DNA, 23 bp, Artificial Sequence
  Synthetic oligonucleotide
agcagggtaggtcagagagaggg

SEQ ID NO: 8539 - DNA, 24 bp, Artificial Sequence
  Synthetic oligonucleotide
tgcagtgactgtccagagtgaggc

SEQ ID NO: 8540 - DNA, 23 bp, Artificial Sequence
  Synthetic oligonucleotide
agcagaggtgaggtgagtgaggg

SEQ ID NO: 8541 - DNA, 23 bp, Artificial Sequence
  Synthetic oligonucleotide
agcagtttaaatttgagtgaggc

SEQ ID NO: 8542 - DNA, 23 bp, Artificial Sequence
  Synthetic oligonucleotide
agaaaggtcataatgagtgaggg

SEQ ID NO: 8543 - DNA, 24 bp, Artificial Sequence
  Synthetic oligonucleotide
agcacaatcccaaaggagtgaggc

SEQ ID NO: 8544 - DNA, 23 bp, Artificial Sequence
  Synthetic oligonucleotide
agcaaaggcaggaggagtgaggt

SEQ ID NO: 8545 - DNA, 23 bp, Artificial Sequence
  Synthetic oligonucleotide
agccacatcccctagagtgaggt

SEQ ID NO: 8546 - DNA, 23 bp, Artificial Sequence
  Synthetic oligonucleotide
tgctgggtctacaggagtgaggc

SEQ ID NO: 8547 - DNA, 23 bp, Artificial Sequence
  Synthetic oligonucleotide
ggcagtgtgagctggagtgaggg

SEQ ID NO: 8548 - DNA, 23 bp, Artificial Sequence
  Synthetic oligonucleotide
agtagtgtgctgaagagtgaggg

SEQ ID NO: 8549 - DNA, 24 bp, Artificial Sequence
  Synthetic oligonucleotide
tgcatggtcagaggtgagtgaggg

SEQ ID NO: 8550 - DNA, 24 bp, Artificial Sequence
  Synthetic oligonucleotide
agcatagtttaggatcagtgagga

SEQ ID NO: 8551 - DNA, 24 bp, Artificial Sequence
  Synthetic oligonucleotide
agcagcaggatgagagagtgaggc

SEQ ID NO: 8552 - DNA, 24 bp, Artificial Sequence
  Synthetic oligonucleotide
agcaccattaaattggagtgaggc

SEQ ID NO: 8553 - DNA, 23 bp, Artificial Sequence
  Synthetic oligonucleotide
atcagggttaagcagagtgaggg

SEQ ID NO: 8554 - DNA, 23 bp, Artificial Sequence
  Synthetic oligonucleotide
agcaaagtggagaggagggagga

SEQ ID NO: 8555 - DNA, 24 bp, Artificial Sequence
  Synthetic oligonucleotide
agcaacaccaatgaagagtgaaga

SEQ ID NO: 8556 - DNA, 23 bp, Artificial Sequence
  Synthetic oligonucleotide
ggcagtggctctgtgagtgaggt

SEQ ID NO: 8557 - DNA, 24 bp, Artificial Sequence
  Synthetic oligonucleotide
agtatcggctgtggtgagtgaggg

SEQ ID NO: 8558 - DNA, 24 bp, Artificial Sequence
  Synthetic oligonucleotide
ggcagctccgcctccgagtgaggg

SEQ ID NO: 8559 - DNA, 24 bp, Artificial Sequence
  Synthetic oligonucleotide
agcaaaggctgggtggagtgaggt

SEQ ID NO: 8560 - DNA, 23 bp, Artificial Sequence
  Synthetic oligonucleotide
agcaagttccactggagtgtgga

SEQ ID NO: 8561 - DNA, 23 bp, Artificial Sequence
  Synthetic oligonucleotide
agcaaaggcagtcagagtgaggg

SEQ ID NO: 8562 - DNA, 24 bp, Artificial Sequence
  Synthetic oligonucleotide
cgcagcaacgctctggagtgaggc

SEQ ID NO: 8563 - DNA, 23 bp, Artificial Sequence
  Synthetic oligonucleotide
ggcagcggttgggggagtgaggc

SEQ ID NO: 8564 - DNA, 23 bp, Artificial Sequence
  Synthetic oligonucleotide
agcaactgcttttagagtgagca

SEQ ID NO: 8565 - DNA, 23 bp, Artificial Sequence
  Synthetic oligonucleotide
agaagagtaaagcagagtgaggt

SEQ ID NO: 8566 - DNA, 24 bp, Artificial Sequence
  Synthetic oligonucleotide
agcaacataataacagagtgaggt

SEQ ID NO: 8567 - DNA, 24 bp, Artificial Sequence
  Synthetic oligonucleotide
cgcaccttcctgtatgagtgaggc

SEQ ID NO: 8568 - DNA, 23 bp, Artificial Sequence
  Synthetic oligonucleotide
gtccgcgtcgcccagagtgagaa

SEQ ID NO: 8569 - DNA, 24 bp, Artificial Sequence
  Synthetic oligonucleotide
ggcagtgtgcttgatgagtgaggg

SEQ ID NO: 8570 - DNA, 24 bp, Artificial Sequence
  Synthetic oligonucleotide
cccaccgtcctaaagaagtgagga

SEQ ID NO: 8571 - DNA, 24 bp, Artificial Sequence
  Synthetic oligonucleotide
aacaacgtgaaaccagagtgaggc

SEQ ID NO: 8572 - DNA, 23 bp, Artificial Sequence
  Synthetic oligonucleotide
agcaaccacaaaaaaagtgagga

SEQ ID NO: 8573 - DNA, 24 bp, Artificial Sequence
  Synthetic oligonucleotide
agccccttcagcatagagtgaggg

SEQ ID NO: 8574 - DNA, 24 bp, Artificial Sequence
  Synthetic oligonucleotide
agccgctgcagcagggagtgaggt

SEQ ID NO: 8575 - DNA, 24 bp, Artificial Sequence
  Synthetic oligonucleotide
agccgctgcagcagggagtgaggt

SEQ ID NO: 8576 - DNA, 24 bp, Artificial Sequence
  Synthetic oligonucleotide
agccgctgcagcagggagtgaggt

SEQ ID NO: 8577 - DNA, 24 bp, Artificial Sequence
  Synthetic oligonucleotide
agccgctgcagcagggagtgaggt

SEQ ID NO: 8578 - DNA, 23 bp, Artificial Sequence
  Synthetic oligonucleotide
agaggggtctgcaggagtgaggg

SEQ ID NO: 8579 - DNA, 23 bp, Artificial Sequence
  Synthetic oligonucleotide
agcaaaggcaaatagagtgaggg

SEQ ID NO: 8580 - DNA, 23 bp, Artificial Sequence
  Synthetic oligonucleotide
ggcaacttccaagaaagtgagga

SEQ ID NO: 8581 - DNA, 24 bp, Artificial Sequence
  Synthetic oligonucleotide
gccagcttccatacagagtgaggc

SEQ ID NO: 8582 - DNA, 23 bp, Artificial Sequence
  Synthetic oligonucleotide
agaagggtgattaggagtgaggc

SEQ ID NO: 8583 - DNA, 24 bp, Artificial Sequence
  Synthetic oligonucleotide
agctacgactcaggagagtgaggt

SEQ ID NO: 8584 - DNA, 23 bp, Artificial Sequence
  Synthetic oligonucleotide
agcaaggtgggcgggagtgaggg

SEQ ID NO: 8585 - DNA, 24 bp, Artificial Sequence
  Synthetic oligonucleotide
aggagagttagaagagagtgaggt

SEQ ID NO: 8586 - DNA, 24 bp, Artificial Sequence
  Synthetic oligonucleotide
tgctccgtcctggctgagtgaggt

SEQ ID NO: 8587 - DNA, 23 bp, Artificial Sequence
  Synthetic oligonucleotide
agcactgtttgcccgagtgaggc

SEQ ID NO: 8588 - DNA, 24 bp, Artificial Sequence
  Synthetic oligonucleotide
agtaccatcagggctgagtgaggc

SEQ ID NO: 8589 - DNA, 23 bp, Artificial Sequence
  Synthetic oligonucleotide
agcagcagggcagtgagtgaggc

SEQ ID NO: 8590 - DNA, 23 bp, Artificial Sequence
  Synthetic oligonucleotide
ggcagggaccatatgagtgaggc

SEQ ID NO: 8591 - DNA, 23 bp, Artificial Sequence
  Synthetic oligonucleotide
agcaaggttccccggagtgagta

SEQ ID NO: 8592 - DNA, 23 bp, Artificial Sequence
  Synthetic oligonucleotide
agcatgggcagggggagtgaggc

SEQ ID NO: 8593 - DNA, 23 bp, Artificial Sequence
  Synthetic oligonucleotide
agctgagtagctaagagtgaggc

SEQ ID NO: 8594 - DNA, 24 bp, Artificial Sequence
  Synthetic oligonucleotide
agcgacttcatatctgagtgaggt

SEQ ID NO: 8595 - DNA, 23 bp, Artificial Sequence
  Synthetic oligonucleotide
aggagagtttaaaggagtgaggt

SEQ ID NO: 8596 - DNA, 24 bp, Artificial Sequence
  Synthetic oligonucleotide
gacagcatcagtctggagtgaggg

SEQ ID NO: 8597 - DNA, 23 bp, Artificial Sequence
  Synthetic oligonucleotide
agcaactccatttcgagtgaggc

SEQ ID NO: 8598 - DNA, 24 bp, Artificial Sequence
  Synthetic oligonucleotide
agtcgcttcactttggagtgagaa

SEQ ID NO: 8599 - DNA, 24 bp, Artificial Sequence
  Synthetic oligonucleotide
agtaacatctttactgagggagga

SEQ ID NO: 8600 - DNA, 24 bp, Artificial Sequence
  Synthetic oligonucleotide
agcaactgcaatggtgagtgagca

SEQ ID NO: 8601 - DNA, 23 bp, Artificial Sequence
  Synthetic oligonucleotide
agcattgtgctaggcagtgagga

SEQ ID NO: 8602 - DNA, 24 bp, Artificial Sequence
  Synthetic oligonucleotide
agaaaagtcttgaaggagtgaggg

SEQ ID NO: 8603 - DNA, 23 bp, Artificial Sequence
  Synthetic oligonucleotide
ggcagtgtagggaggagtgaggt

SEQ ID NO: 8604 - DNA, 24 bp, Artificial Sequence
  Synthetic oligonucleotide
agcaaggtaaaggaggagtgaggt

SEQ ID NO: 8605 - DNA, 23 bp, Artificial Sequence
  Synthetic oligonucleotide
agcatctgcagatggagtgaggc

SEQ ID NO: 8606 - DNA, 23 bp, Artificial Sequence
  Synthetic oligonucleotide
tgcatagtcttggggagtgaggg

SEQ ID NO: 8607 - DNA, 24 bp, Artificial Sequence
  Synthetic oligonucleotide
agaagggtgaggtgggagtgaggc

SEQ ID NO: 8608 - DNA, 23 bp, Artificial Sequence
  Synthetic oligonucleotide
agccgagtggttaagagtgaggg

SEQ ID NO: 8609 - DNA, 24 bp, Artificial Sequence
  Synthetic oligonucleotide
ctcagggtcattagtgagtgaggg

SEQ ID NO: 8610 - DNA, 23 bp, Artificial Sequence
  Synthetic oligonucleotide
aacagggttggcctgagtgaggc

SEQ ID NO: 8611 - DNA, 24 bp, Artificial Sequence
  Synthetic oligonucleotide
agcctagtcacacctgagtgaggg

SEQ ID NO: 8612 - DNA, 23 bp, Artificial Sequence
  Synthetic oligonucleotide
agcaatgttttgctgagtgagaa

SEQ ID NO: 8613 - DNA, 24 bp, Artificial Sequence
  Synthetic oligonucleotide
agcagcaaatctgctgagtgaggt

SEQ ID NO: 8614 - DNA, 24 bp, Artificial Sequence
  Synthetic oligonucleotide
agcagtccctgcccagagtgaggc

SEQ ID NO: 8615 - DNA, 23 bp, Artificial Sequence
  Synthetic oligonucleotide
tgcaatgtctttgagagtgaggt

SEQ ID NO: 8616 - DNA, 23 bp, Artificial Sequence
  Synthetic oligonucleotide
tgcaggttctttgggagtgaggg

SEQ ID NO: 8617 - DNA, 24 bp, Artificial Sequence
  Synthetic oligonucleotide
agctaagtctgtaggcagtgagga

SEQ ID NO: 8618 - DNA, 23 bp, Artificial Sequence
  Synthetic oligonucleotide
agcatagttgggagcagtgagga

SEQ ID NO: 8619 - DNA, 24 bp, Artificial Sequence
  Synthetic oligonucleotide
agcatggtagagactgagtgaggg

SEQ ID NO: 8620 - DNA, 24 bp, Artificial Sequence
  Synthetic oligonucleotide
agcaaggactgggctgagtgaggc

SEQ ID NO: 8621 - DNA, 24 bp, Artificial Sequence
  Synthetic oligonucleotide
aggtgggtccccagagagtgaggc

SEQ ID NO: 8622 - DNA, 24 bp, Artificial Sequence
  Synthetic oligonucleotide
agcagctgtcaatcagagtgaggc

SEQ ID NO: 8623 - DNA, 24 bp, Artificial Sequence
  Synthetic oligonucleotide
tgcatggtcctggaggagtgaggg

SEQ ID NO: 8624 - DNA, 23 bp, Artificial Sequence
  Synthetic oligonucleotide
agcatagtacttaagagtgaggg

SEQ ID NO: 8625 - DNA, 23 bp, Artificial Sequence
  Synthetic oligonucleotide
agcaaggtaattaggagtgagta

SEQ ID NO: 8626 - DNA, 24 bp, Artificial Sequence
  Synthetic oligonucleotide
tgcaccttcatgcctgagtgaggg

SEQ ID NO: 8627 - DNA, 24 bp, Artificial Sequence
  Synthetic oligonucleotide
agcaccgaggtcggagagtgaggg

SEQ ID NO: 8628 - DNA, 23 bp, Artificial Sequence
  Synthetic oligonucleotide
tggagagtcagcaggagtgagta

SEQ ID NO: 8629 - DNA, 24 bp, Artificial Sequence
  Synthetic oligonucleotide
agaagagttaggtgggagtgaggt

SEQ ID NO: 8630 - DNA, 23 bp, Artificial Sequence
  Synthetic oligonucleotide
atcagggttaggatgagtgaggg

SEQ ID NO: 8631 - DNA, 24 bp, Artificial Sequence
  Synthetic oligonucleotide
ggcagtgcccagcaggagtgaggc

SEQ ID NO: 8632 - DNA, 23 bp, Artificial Sequence
  Synthetic oligonucleotide
agtaaggtcttaaatagtgagga

SEQ ID NO: 8633 - DNA, 23 bp, Artificial Sequence
  Synthetic oligonucleotide
agcagcaggccagtgagtgaggc

SEQ ID NO: 8634 - DNA, 23 bp, Artificial Sequence
  Synthetic oligonucleotide
agccatgtgcaagtgagtgagga

SEQ ID NO: 8635 - DNA, 24 bp, Artificial Sequence
  Synthetic oligonucleotide
ggtagtgttatgaatgagtgagga

SEQ ID NO: 8636 - DNA, 23 bp, Artificial Sequence
  Synthetic oligonucleotide
tacaaagtcgatgagagtgagga

SEQ ID NO: 8637 - DNA, 23 bp, Artificial Sequence
  Synthetic oligonucleotide
agccatgtacatgtgagtgagga

SEQ ID NO: 8638 - DNA, 24 bp, Artificial Sequence
  Synthetic oligonucleotide
gactgggtctgtcatgagtgagga

SEQ ID NO: 8639 - DNA, 23 bp, Artificial Sequence
  Synthetic oligonucleotide
agcacagcagatgagagtgagga

SEQ ID NO: 8640 - DNA, 24 bp, Artificial Sequence
  Synthetic oligonucleotide
tgaatagtcttggaagagtgagga

SEQ ID NO: 8641 - DNA, 24 bp, Artificial Sequence
  Synthetic oligonucleotide
gtcaggttcacacatgagtgagga

SEQ ID NO: 8642 - DNA, 24 bp, Artificial Sequence
  Synthetic oligonucleotide
ggtaaagtctggtcagagtgagga

SEQ ID NO: 8643 - DNA, 23 bp, Artificial Sequence
  Synthetic oligonucleotide
agtatagtggcagagagtgagga

SEQ ID NO: 8644 - DNA, 24 bp, Artificial Sequence
  Synthetic oligonucleotide
atgggggtcagaggggagtgagga

SEQ ID NO: 8645 - DNA, 23 bp, Artificial Sequence
  Synthetic oligonucleotide
cccaaagtcgtaaggagtgagga

SEQ ID NO: 8646 - DNA, 23 bp, Artificial Sequence
  Synthetic oligonucleotide
caaatcgtctacatgagtgagga

SEQ ID NO: 8647 - DNA, 24 bp, Artificial Sequence
  Synthetic oligonucleotide
aataaggtcatagcagagtgagga

SEQ ID NO: 8648 - DNA, 23 bp, Artificial Sequence
  Synthetic oligonucleotide
agtatagttcagatgagtgagga

SEQ ID NO: 8649 - DNA, 23 bp, Artificial Sequence
  Synthetic oligonucleotide
agagaggtcaaggagagtgagga

SEQ ID NO: 8650 - DNA, 23 bp, Artificial Sequence
  Synthetic oligonucleotide
tggtgagtcaccacgagtgagga

SEQ ID NO: 8651 - DNA, 24 bp, Artificial Sequence
  Synthetic oligonucleotide
tgcctggtcacttgggagtgagga

SEQ ID NO: 8652 - DNA, 23 bp, Artificial Sequence
  Synthetic oligonucleotide
agccatgtgggaaggagtgagga

SEQ ID NO: 8653 - DNA, 24 bp, Artificial Sequence
  Synthetic oligonucleotide
aacaaggttcgcagagagtgagga

SEQ ID NO: 8654 - DNA, 24 bp, Artificial Sequence
  Synthetic oligonucleotide
agcaatttatgtacagagtgagga

SEQ ID NO: 8655 - DNA, 24 bp, Artificial Sequence
  Synthetic oligonucleotide
aggcatgtctcagcagagtgagga

SEQ ID NO: 8656 - DNA, 23 bp, Artificial Sequence
  Synthetic oligonucleotide
tacaaagtccttaggagtgagga

SEQ ID NO: 8657 - DNA, 24 bp, Artificial Sequence
  Synthetic oligonucleotide
aataaggtcagagaggagtgagga

SEQ ID NO: 8658 - DNA, 24 bp, Artificial Sequence
  Synthetic oligonucleotide
aataaagtcagataggagtgagga

SEQ ID NO: 8659 - DNA, 24 bp, Artificial Sequence
  Synthetic oligonucleotide
aataaggtcagataggagtgagga

SEQ ID NO: 8660 - DNA, 24 bp, Artificial Sequence
  Synthetic oligonucleotide
aataaggtcaaataggagtgagga

SEQ ID NO: 8661 - DNA, 23 bp, Artificial Sequence
  Synthetic oligonucleotide
aataaggtcagatggagtgagga

SEQ ID NO: 8662 - DNA, 24 bp, Artificial Sequence
  Synthetic oligonucleotide
aataaggtcagataggagtgagga

SEQ ID NO: 8663 - DNA, 23 bp, Artificial Sequence
  Synthetic oligonucleotide
agcacagcaggcaggagtgagga

SEQ ID NO: 8664 - DNA, 24 bp, Artificial Sequence
  Synthetic oligonucleotide
ggaaaggtcagttatgagtgagga

SEQ ID NO: 8665 - DNA, 23 bp, Artificial Sequence
  Synthetic oligonucleotide
agccatttcaacaagagtgagga

SEQ ID NO: 8666 - DNA, 24 bp, Artificial Sequence
  Synthetic oligonucleotide
aataaggtcacggtggagtgagga

SEQ ID NO: 8667 - DNA, 23 bp, Artificial Sequence
  Synthetic oligonucleotide
atcagcacttcagagagtgagga

SEQ ID NO: 8668 - DNA, 23 bp, Artificial Sequence
  Synthetic oligonucleotide
ggtggggtcatggagagtgagga

SEQ ID NO: 8669 - DNA, 24 bp, Artificial Sequence
  Synthetic oligonucleotide
cacacagtcagtgtagagtgagga

SEQ ID NO: 8670 - DNA, 23 bp, Artificial Sequence
  Synthetic oligonucleotide
aatattgtctctgtgagtgagga

SEQ ID NO: 8671 - DNA, 24 bp, Artificial Sequence
  Synthetic oligonucleotide
ggaatagtctggttagagtgagga

SEQ ID NO: 8672 - DNA, 23 bp, Artificial Sequence
  Synthetic oligonucleotide
agcaacaatcgtacgagtgagga

SEQ ID NO: 8673 - DNA, 24 bp, Artificial Sequence
  Synthetic oligonucleotide
aataaggtcacagtggagtgagga

SEQ ID NO: 8674 - DNA, 23 bp, Artificial Sequence
  Synthetic oligonucleotide
gactgtgtccttcagagtgagga

SEQ ID NO: 8675 - DNA, 24 bp, Artificial Sequence
  Synthetic oligonucleotide
aataaagtcagataggagtgagga

SEQ ID NO: 8676 - DNA, 24 bp, Artificial Sequence
  Synthetic oligonucleotide
aataaggtcagagaggagtgagga

SEQ ID NO: 8677 - DNA, 24 bp, Artificial Sequence
  Synthetic oligonucleotide
aataaggtcagacaagagtgagga

SEQ ID NO: 8678 - DNA, 24 bp, Artificial Sequence
  Synthetic oligonucleotide
aataaggtcagataggagtgagga

SEQ ID NO: 8679 - DNA, 23 bp, Artificial Sequence
  Synthetic oligonucleotide
aataaggtcagatggagtgagga

SEQ ID NO: 8680 - DNA, 23 bp, Artificial Sequence
  Synthetic oligonucleotide
agcagcttcccctgcagaaaggt

SEQ ID NO: 8681 - DNA, 23 bp, Artificial Sequence
  Synthetic oligonucleotide
ggcaacgtcatctctagtgagac

SEQ ID NO: 8682 - DNA, 24 bp, Artificial Sequence
  Synthetic oligonucleotide
agcagtttcttttacttgtgaggg

SEQ ID NO: 8683 - DNA, 24 bp, Artificial Sequence
  Synthetic oligonucleotide
agcagtttcagtatcttgtgaggg

SEQ ID NO: 8684 - DNA, 23 bp, Artificial Sequence
  Synthetic oligonucleotide
agcagcagccgaacgagggagat

SEQ ID NO: 8685 - DNA, 23 bp, Artificial Sequence
  Synthetic oligonucleotide
agcagcagcccagggagggagat

SEQ ID NO: 8686 - DNA, 23 bp, Artificial Sequence
  Synthetic oligonucleotide
agcaacttctctaattgtgaggt

SEQ ID NO: 8687 - DNA, 23 bp, Artificial Sequence
  Synthetic oligonucleotide
agcaacttccacagttgtgaggt

SEQ ID NO: 8688 - DNA, 23 bp, Artificial Sequence
  Synthetic oligonucleotide
agcaaggtcagtgatagtgaata

SEQ ID NO: 8689 - DNA, 24 bp, Artificial Sequence
  Synthetic oligonucleotide
agcagtttcggtgttttgtgaggg

SEQ ID NO: 8690 - DNA, 23 bp, Artificial Sequence
  Synthetic oligonucleotide
agcagcagcaggaagagggagat

SEQ ID NO: 8691 - DNA, 23 bp, Artificial Sequence
  Synthetic oligonucleotide
agcattgtcttagaaagtaaggg

SEQ ID NO: 8692 - DNA, 23 bp, Artificial Sequence
  Synthetic oligonucleotide
agcccagtctcagggagtgagag

SEQ ID NO: 8693 - DNA, 24 bp, Artificial Sequence
  Synthetic oligonucleotide
agctacatctgcattgagtgagtc

SEQ ID NO: 8694 - DNA, 24 bp, Artificial Sequence
  Synthetic oligonucleotide
agcatggtttgaaaggagtgagcc

SEQ ID NO: 8695 - DNA, 24 bp, Artificial Sequence
  Synthetic oligonucleotide
gacagggtccacttggagtgagtc

SEQ ID NO: 8696 - DNA, 23 bp, Artificial Sequence
  Synthetic oligonucleotide
atcctcgtcctgcagagtgagtc

SEQ ID NO: 8697 - DNA, 23 bp, Artificial Sequence
  Synthetic oligonucleotide
cagagcgtccaggtgagtgagtc

SEQ ID NO: 8698 - DNA, 24 bp, Artificial Sequence
  Synthetic oligonucleotide
agcaaaggcctgaaggagtaaggg

SEQ ID NO: 8699 - DNA, 23 bp, Artificial Sequence
  Synthetic oligonucleotide
agcatcgattaaaagagtgagag

SEQ ID NO: 8700 - DNA, 23 bp, Artificial Sequence
  Synthetic oligonucleotide
atcatggtcactttgagggaggg

SEQ ID NO: 8701 - DNA, 24 bp, Artificial Sequence
  Synthetic oligonucleotide
agcccagtccccctagagtgagag

SEQ ID NO: 8702 - DNA, 23 bp, Artificial Sequence
  Synthetic oligonucleotide
tgcatagtcaatttgagtgagat

SEQ ID NO: 8703 - DNA, 23 bp, Artificial Sequence
  Synthetic oligonucleotide
agccatgtcagcttgagggaggt

SEQ ID NO: 8704 - DNA, 24 bp, Artificial Sequence
  Synthetic oligonucleotide
agcattgtaggggacgagtgtggt

SEQ ID NO: 8705 - DNA, 23 bp, Artificial Sequence
  Synthetic oligonucleotide
atcatggtccaggagagggaggg

SEQ ID NO: 8706 - DNA, 23 bp, Artificial Sequence
  Synthetic oligonucleotide
agcaaaggccaagtgagtaaggg

SEQ ID NO: 8707 - DNA, 24 bp, Artificial Sequence
  Synthetic oligonucleotide
ataagagtcatgcaggagtgagtg

SEQ ID NO: 8708 - DNA, 24 bp, Artificial Sequence
  Synthetic oligonucleotide
agccatgtcccaagggagggaggt

SEQ ID NO: 8709 - DNA, 23 bp, Artificial Sequence
  Synthetic oligonucleotide
agcaaaggcaatgagagtaaggg

SEQ ID NO: 8710 - DNA, 23 bp, Artificial Sequence
  Synthetic oligonucleotide
agcccagtcaggatgagtgagag

SEQ ID NO: 8711 - DNA, 23 bp, Artificial Sequence
  Synthetic oligonucleotide
ttccacgtcaacatgagtgaggg

SEQ ID NO: 8712 - DNA, 24 bp, Artificial Sequence
  Synthetic oligonucleotide
agtcaggtccccacagagtgaggt

SEQ ID NO: 8713 - DNA, 23 bp, Artificial Sequence
  Synthetic oligonucleotide
ctgagggtcggtaggagtgaggc

SEQ ID NO: 8714 - DNA, 24 bp, Artificial Sequence
  Synthetic oligonucleotide
atgacagtctatgcagagtgaggc

SEQ ID NO: 8715 - DNA, 23 bp, Artificial Sequence
  Synthetic oligonucleotide
aacagtctacctgagagtgaggc

SEQ ID NO: 8716 - DNA, 23 bp, Artificial Sequence
  Synthetic oligonucleotide
ctcagtttcctgaggagtgaggg

SEQ ID NO: 8717 - DNA, 24 bp, Artificial Sequence
  Synthetic oligonucleotide
agtcaggtcttccatgagtgaggg

SEQ ID NO: 8718 - DNA, 24 bp, Artificial Sequence
  Synthetic oligonucleotide
gtgggcgtccactaagagtgaggc

SEQ ID NO: 8719 - DNA, 24 bp, Artificial Sequence
  Synthetic oligonucleotide
ggtggggtccttgaagagtgaggc

SEQ ID NO: 8720 - DNA, 24 bp, Artificial Sequence
  Synthetic oligonucleotide
agttaagtctctagagagtgaggg

SEQ ID NO: 8721 - DNA, 24 bp, Artificial Sequence
  Synthetic oligonucleotide
ttcaccttccaccatgagtgaggc

SEQ ID NO: 8722 - DNA, 24 bp, Artificial Sequence
  Synthetic oligonucleotide
tcctgagtcttggtagagtgaggc

SEQ ID NO: 8723 - DNA, 23 bp, Artificial Sequence
  Synthetic oligonucleotide
ataatagtctccatgagtgaggc

SEQ ID NO: 8724 - DNA, 24 bp, Artificial Sequence
  Synthetic oligonucleotide
agcaaaggtggggtggagtgaggt

SEQ ID NO: 8725 - DNA, 23 bp, Artificial Sequence
  Synthetic oligonucleotide
agtttagtccttgggagtgaggt

SEQ ID NO: 8726 - DNA, 23 bp, Artificial Sequence
  Synthetic oligonucleotide
acaaaggtcctccagagtgaggc

SEQ ID NO: 8727 - DNA, 23 bp, Artificial Sequence
  Synthetic oligonucleotide
tgcagtcccaatcagagtgaggt

SEQ ID NO: 8728 - DNA, 23 bp, Artificial Sequence
  Synthetic oligonucleotide
agtcatgtcgttaagagtgaggc

SEQ ID NO: 8729 - DNA, 24 bp, Artificial Sequence
  Synthetic oligonucleotide
caccacgtcaaggtagagagagga

SEQ ID NO: 8730 - DNA, 24 bp, Artificial Sequence
  Synthetic oligonucleotide
ctcagtttcaaaagcgagtgaggg

SEQ ID NO: 8731 - DNA, 24 bp, Artificial Sequence
  Synthetic oligonucleotide
gaaagtgtccaagtggagtgaggc

SEQ ID NO: 8732 - DNA, 24 bp, Artificial Sequence
  Synthetic oligonucleotide
gggtgggtctagagggagtgaggt

SEQ ID NO: 8733 - DNA, 24 bp, Artificial Sequence
  Synthetic oligonucleotide
agagttgtcccccaagagtgaggc

SEQ ID NO: 8734 - DNA, 23 bp, Artificial Sequence
  Synthetic oligonucleotide
agaaggggtaggaggagtgagag

SEQ ID NO: 8735 - DNA, 23 bp, Artificial Sequence
  Synthetic oligonucleotide
agcagagtcatattgagtcaggg

SEQ ID NO: 8736 - DNA, 23 bp, Artificial Sequence
  Synthetic oligonucleotide
accatcttcatcaggagtgagga

SEQ ID NO: 8737 - DNA, 23 bp, Artificial Sequence
  Synthetic oligonucleotide
aggaacgtctccaagggtgaggg

SEQ ID NO: 8738 - DNA, 23 bp, Artificial Sequence
  Synthetic oligonucleotide
agcaccttcagagggagtgtggc

SEQ ID NO: 8739 - DNA, 23 bp, Artificial Sequence
  Synthetic oligonucleotide
ggcagggtcggtcagagtgagag

SEQ ID NO: 8740 - DNA, 24 bp, Artificial Sequence
  Synthetic oligonucleotide
ggcagggtcacaggtgagtgagag

SEQ ID NO: 8741 - DNA, 23 bp, Artificial Sequence
  Synthetic oligonucleotide
agcacagtcaagctgagggaggt

SEQ ID NO: 8742 - DNA, 24 bp, Artificial Sequence
  Synthetic oligonucleotide
ggcagggtctaggcagagtgagag

SEQ ID NO: 8743 - DNA, 24 bp, Artificial Sequence
  Synthetic oligonucleotide
agcaaggtctactcggggtgaggc

SEQ ID NO: 8744 - DNA, 24 bp, Artificial Sequence
  Synthetic oligonucleotide
agcaagttccgttaagagtgaggt

SEQ ID NO: 8745 - DNA, 24 bp, Artificial Sequence
  Synthetic oligonucleotide
agcagtttttgcagtgagtgaggc

SEQ ID NO: 8746 - DNA, 23 bp, Artificial Sequence
  Synthetic oligonucleotide
agctgcgtcacatggactgagga

SEQ ID NO: 8747 - DNA, 24 bp, Artificial Sequence
  Synthetic oligonucleotide
agcagggtctgagctgtgtgggga

SEQ ID NO: 8748 - DNA, 23 bp, Artificial Sequence
  Synthetic oligonucleotide
agcagggtcagctggtgtgggga

SEQ ID NO: 8749 - DNA, 24 bp, Artificial Sequence
  Synthetic oligonucleotide
agaagcctcaaggatgagtgaggt

SEQ ID NO: 8750 - DNA, 24 bp, Artificial Sequence
  Synthetic oligonucleotide
agaagcctcataagtgagtgaggt

SEQ ID NO: 8751 - DNA, 23 bp, Artificial Sequence
  Synthetic oligonucleotide
agcattttcaatttgagtgagga

SEQ ID NO: 8752 - DNA, 23 bp, Artificial Sequence
  Synthetic oligonucleotide
agcagcgtccctccgacactgga

SEQ ID NO: 8753 - DNA, 24 bp, Artificial Sequence
  Synthetic oligonucleotide
agcagtgtcaccgacaggtgaggc

SEQ ID NO: 8754 - DNA, 23 bp, Artificial Sequence
  Synthetic oligonucleotide
agcagtgtctgggagagggtaga

SEQ ID NO: 8755 - DNA, 23 bp, Artificial Sequence
  Synthetic oligonucleotide
agcaacttcttcctgggtgaggc

SEQ ID NO: 8756 - DNA, 24 bp, Artificial Sequence
  Synthetic oligonucleotide
agcccggtctgaaaggagtgaaga

SEQ ID NO: 8757 - DNA, 24 bp, Artificial Sequence
  Synthetic oligonucleotide
agtaacttctgagtggagtgaggc

SEQ ID NO: 8758 - DNA, 23 bp, Artificial Sequence
  Synthetic oligonucleotide
agtaacttcaaaatgagtgaggc

SEQ ID NO: 8759 - DNA, 23 bp, Artificial Sequence
  Synthetic oligonucleotide
acctgcttcaaagtgagtgaggg

SEQ ID NO: 8760 - DNA, 24 bp, Artificial Sequence
  Synthetic oligonucleotide
agcattttccccctaaagtgagga

SEQ ID NO: 8761 - DNA, 24 bp, Artificial Sequence
  Synthetic oligonucleotide
agtaacttcagtatagagtgaggc

SEQ ID NO: 8762 - DNA, 23 bp, Artificial Sequence
  Synthetic oligonucleotide
agcaatgtttgagtgagtgatga

SEQ ID NO: 8763 - DNA, 23 bp, Artificial Sequence
  Synthetic oligonucleotide
agcattttcctttaaagtgagga

SEQ ID NO: 8764 - DNA, 24 bp, Artificial Sequence
  Synthetic oligonucleotide
agccacggctgcctggagtgaggg

SEQ ID NO: 8765 - DNA, 23 bp, Artificial Sequence
  Synthetic oligonucleotide
cctagagtccaggagagtgagga

SEQ ID NO: 8766 - DNA, 23 bp, Artificial Sequence
  Synthetic oligonucleotide
atcatagtgaccacgagtgaggc

What is claimed is:

1. A method comprising:
   (a) providing a dimeric site-specific nuclease that cuts one or more double-stranded target sites of a double-stranded nucleic acid and creates a 5' overhang on the double-stranded nucleic acid, wherein the dimeric site-specific nuclease comprises two monomers, each of which comprises a site-specific DNA binding domain and a cleavage domain; wherein each of the one or more double-stranded target sites of the dimeric site-specific nuclease comprises a 5'-[left-half site]-[spacer sequence]-[right-half site]-3' (LSR) structure, and wherein the left-half site comprises a nucleic acid sequence that is bound by the site-specific DNA binding domain of one monomer of the dimeric site-specific nuclease and the right-half site comprises a nucleic acid sequence that is bound by the site-specific DNA binding domain of other monomer of the dimeric site-specific nuclease, and wherein the spacer sequence comprises a cleavage site of the dimeric site-specific nuclease;
   (b) contacting the dimeric site-specific nuclease of step (a) with a library of candidate nucleic acid molecules, wherein each of the candidate nucleic acid molecules of the library comprises a concatemer containing multiple copies of the same DNA sequences linked in a series, wherein each copy of the same DNA sequences comprises one of the double-stranded target sites of the dimeric site-specific nuclease and a constant insert sequence, wherein the contacting step is done under conditions suitable for the dimeric site-specific nuclease to cut the candidate nucleic acid molecules once, twice, or multiple times, thereby releasing double-stranded fragments with 5' overhangs from the concatemer, whereby each strand of the double-stranded fragments has a 5' overhang, each of the double-stranded fragments comprises a first strand comprising the constant insert sequence flanked at the 5' end by the right-half site and a part of the spacer sequence and a complementary strand of each of the double stranded fragments comprises the constant insert sequence flanked at the 5' end by the left-half site and a part of the spacer sequence, wherein the double-stranded fragments with 5' overhangs are released when the candidate nucleic acid molecules are cut twice by the dimeric site-specific nuclease;
   (c) filling in the 5' overhangs of the double-stranded fragments released in step (b), thereby creating fragments with blunt ends; and
   (d) identifying the one or more double-stranded target sites of the dimeric site-specific nuclease of the double-stranded fragments with 5' overhangs by determining the sequence of the fragments with blunt ends from step (c).

2. The method of claim 1, wherein step (d) further comprises ligating sequencing adapters to the blunt ends of the fragments with blunt ends.

3. The method of claim 2, wherein the method further comprises amplifying the fragments with blunt ends via a polymerase chain reaction (PCR) after said ligating the sequencing adapters to the blunt ends of the fragments with blunt ends.

4. The method of claim 1 further comprising a step of enriching the double-stranded fragments with 5' overhangs released in step (b).

5. The method of claim 4, wherein the step of enriching the double-stranded fragments with 5' overhangs comprises a size fractionation of the double-stranded fragments with 5' overhangs.

6. The method of claim 1, further comprising compiling the one or more double-stranded target sites of the dimeric site-specific nuclease identified in step (d), thereby generating a double-stranded nuclease target site profile.

7. The method of claim 1, wherein the dimeric site-specific nuclease is a therapeutic nuclease which cuts the one or more double-stranded target sites in a gene associated with a disease.

8. The method of claim 7 further comprising determining a maximum concentration of the therapeutic nuclease at which the therapeutic nuclease cuts only one of the double-stranded nuclease target sites, and does not cut more than 10, more than 5, more than 4, more than 3, more than 2, more than 1 of the double-stranded target sites in the candidate nucleic acid molecules.

9. The method of claim 1, wherein the cleavage domain is a non-specific cleavage domain.

10. The method of claim 1, wherein the dimeric site-specific nuclease cleaves a target sequence upon dimerization of the cleavage domain of each of the two monomers.

11. The method of claim 1, wherein the site-specific DNA binding domain comprises a zinc finger.

12. The method of claim 11, wherein the dimeric site-specific nuclease is a Zinc Finger Nuclease.

13. The method of claim 1, wherein the site-specific DNA binding domain comprises a Transcriptional Activator-Like Element.

14. The method of claim 13, wherein the dimeric site-specific nuclease is a Transcriptional Activator-Like Element Nuclease (TALEN).

15. The method of claim 1, wherein the cleavage domain is a cleavage domain of an endonuclease.

16. The method of claim 15, wherein the endonuclease is FokI.

17. The method of claim 1, wherein the dimeric site-specific nuclease is a homing nuclease.

* * * * *